United States Patent 11,141,474 (ARTIFICIAL NUCLEIC ACID MOLECULES ENCODING A NOROVIRUS ANTIGEN AND USES THEREOF) - sequence listing, part 10

SEQ ID NO: 21449 - RNA, 1614 nt, Artificial Sequence
  derived and/or modified sequence opt3 from VP1__Norovirus_and/or_Norovirus-like__EU078406
augaagauggccagcuccgacgcuaaccccucugauggcucagcagccaaucuggugccugaggucaacaaugaaguuauggcgcucgagccagugguaggggcugccaucgcagccccgguggcuggacagcaaaacauuauagaccccuggaucagaaauaacuucguccaggcaccugguggcgaauuuaccgugaguccaaggaaugcccccggggagauucuuuggagcgcuccucugggaccagauuugaaccccuacuuaucccaccugucucggauguauaauggcuacgccgguggguucgaaguucaggugauccuagcgggaaacgcauuuacagccggcaaaauuaucuucgcugccgucccuccaaauuuuccgacugagggccucucgcccucacaggugacgauguucccucauguaauaguugacgugcgccaacuggagccaguccuuaucccccugccugaugugcgaaacaauuuuuaucacuacaaccaggcacaugacccaaccauuaaguugaucgcuaugcucuauacaccccugcgugccaauaacgcgggggaugacguguucacugucagcugcagaguucugaccaggccgaguccugauuuugacuucauuuuucucgugcccccaacaguagaaucccggaccaaaccuuucacugugcccaucuuaacagucgaggaaaugucuaacagccgcuuuccaauaccccuggagaaacuuuacaccggaccuuccucagauuucgugguucagccacagaaugguagauguacgacugacggcguguugcuggggaccacacaacuaagugccgucaacauuugcaauuucaagggagaugugacucacaucgcaggcagcagggacuaucggaugaaccucguaucucagaauuggaacaauuacgacccgaccgaggaaauucccgcuccucuggguacaccagauuuucaggggaagauccagggacuucugacccaaacgacuggcgccgacggcuccacacgcgcucauaaggccaccguuucaacuggggcagccaacuucacacccaaauugggaagcgugcaguuuaccacggauaccgacaaugauuuccagacaggucaaaacacuaaguuuaccccugucggcgugauccaggacgggagucaccaccagaaugagccacagcaauggguccuccccaacuacucuggacgaacagugcauaauguucaccuggcuccggcgguggcaccuacuuucccaggcgaacaguuacuguuuuucagauccaccaugcccgguuguagcggguauccuaacaugaaucucgauugccuucugccccaggaguggguaaugcauuuuuaccaggaagccgcuccagcccaaucggacgucgcauugcuaagguucgugaacccugauacaggccggguucuguuugaguguaaacuccacaaggccggauauauuaccguggcucacacuggccagcaugaccuggucauacccccaaacggguacuuccguuuugauucuugggugaaucaguucuauacgcuugccccgaugggaaacggugcaggccgcagaagguga

SEQ ID NO: 21450 - RNA, 1614 nt, Artificial Sequence
  derived and/or modified sequence opt3 from VP1__Norovirus_and/or_Norovirus-like__AF472623
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaauauuauagaccccuggaucagaaacaauuucguccaggcuccugguggcgaauuuacagugucaccaaggaacgcacccggggagauucuuuggagugccccucugggaccagauuugaaucccuacuuaagccaccuggcucggauguauaacggcuacgccgguggguucgaaguucaggugauccuagcgggaaaugcauuuacugccggcaaaauuaucuucgcugccgucccuccaaacuuuccgacggagggccucucccccucucaggugaccauguucccucauauaaucguagacguucgccaacuggagccagugcuuauuccccugccugauguccgaaauaacuuuuaucacuacaaucagucgaacgacucaacaaucaaguugauugcaaugcucuauacuccacugcgugcuaacaaugccggggaugacguguucaccgugagcugcagaguccugacaaggcccaguccggauuuugacuucaucuuucucguuccucccaccguggaaucccggacuaaaccauucacaguaccuauauuaaccguggaggaaaugucuaacagccgcuuucccauuccacuggagaaacuuuacacgggacccuccucagcguucgucgugcagccucagaaugguagauguacuaccgauggcguuuugcuggggacaacucaacuaagugccgugaacaucugcaccuucaggggagacgucacacauauugcaggcagccacgauuauaccaugaaucucgcuucucagaacuggaauaacuacgacccaacggaggaaaucccggcuccccuggguacuccugacuuuguggggaagauccagggaaugcuuacacagaccacucgggaggauggcuccacacgcgcccauaaggccaccguaucaacgggcagcguucacuucaccccaaagcuggggagugugcaauacacaacugacaccaauaacgauuuucagacaggacagaauacuaaauucacccccgucggugugauucaagacggcaacaaucaccagaacgaaccucagcagugggucuugccaaauuauucugggcgaacaggacauaacgugcaccucgcacccgccguugcuccgaccuuuccuggcgagcaacuguuauucuuuagauccacuaugccagguuguagcggguaccccaacaugaaucuggauugccuccuuccucaggaaugggugcagcauuucuaucaggaggcggcacccgcccaaucggacguagcucuguugagguuugucaacccagauacgggccgggugcuauucgaguguaagcugcacaaaucuggauacguuacaguggcccacaccggcccucaugaccucgucauacccccaaauggguauuuucguuucgauuccugggugaaccaguuuuacacucuggcaccgaugggaaauggugccggccgcagaagguga

SEQ ID NO: 21451 - RNA, 1614 nt, Artificial Sequence
  derived and/or modified sequence opt3 from VP1__Norovirus_and/or_Norovirus-like__AF427114
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacucaacaauuaaguugaucgcaaugcucuauacuccacugcgugcuaacaaugccggggaugacguguucaccgcgagcugcagaguccugacaaggcccaguccggauuuugacuucauuuuucucguuccucccaccguggaaucccggacuaaaccauucacaguaccuaucuuaaccguggaggaaaugucuaacagccgcuuucccauaccacuggagaaacuuuacacgggacccuccucagccuucgucgugcagccucagaaugguagauguacuaccgauggcguuuugcuggggacaacucaacuaagugcagugaacauuugcaccuucaggggagacgucacacauaucgcuggcagccacgauuauaccaugaaucucgccucucagaacuggaauaacuacgacccaacggaggaaauuccggcuccccuggguacuccugacuuuguggggaagauccagggaguacuuacacagaccacucgggaggauggcuccacacgcgcccauaaggcaaccguuucaacgggcagcgugcacuucaccccaaagcuggggaguguccaauacacaacugacaccaauaacgauuuucagacaggacagaauacuaaauucacccccgugggugucauccaagacggcucuaaccaccagaaugaaccucagcaguggguguugccaaacuauuccgggcgaacaggacauaauguucaccucgcccccgcuguggcgccgaccuuuccuggcgagcaacuguuauucuuuagaagcacuaugccagguuguucgggguaccccaacaugaaccuggauugccuccuuccucaggaauggguacagcauuucuaucaggaggcagcccccgcucaaucugacgucgcccuguugagguuugugaauccagauacgggccggguucuauucgaguguaagcugcacaaauccggauacgugacagucgcacacaccggcccucaugaccucgugauucccccaaacggguauuuucguuucgauucauggguaaaucaguuuuacacucuggccccgaugggaaacggugcuggccgcagaagguga

SEQ ID NO: 21452 - RNA, 1614 nt, Artificial Sequence
  derived and/or modified sequence opt3 from VP1__Norovirus_and/or_Norovirus-like__AY532114
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacucaacaauuaaguugaucgcaaugcucuauacuccacugcgugcuaacaaugccggggaugacguguucaccgucagcugcagaguucugacaaggcccaguccggauuuugacuucauuuuucucgugccucccaccguagaaucccggacuaaaccauucacagugccuaucuuaaccgucgaggaaaugucuaacagccgcuuucccauaccacuggagaaacuuuacacgggacccuccucagcguucgugguucagccucagaaugguagauguacuaccgauggcguguugcuggggacaacucaacuaagugccgucaacauuugcaccuucaggggagacgugacacauaucgcaggcagccacgauuauaccaugaaucucgcuucucagaacuggaauaacuacgacccaacggaggaaauuccggcuccccuggguacuccugacuuuguagggaagauccagggaaugcuuacacagaccacucgggaggauggcuccacacgcgcccauaaggccaccguuucaacgggcagcgugcacuucaccccaaagcuggggaguguccaauacacaacugacaccaauaacgauuuucagacaggacagaauacuaaauucacccccgugggugucauccaagacggcaacaaucaccagaacgaaccucaucaguggguguugccaaauuauucugggcgaacaggacacaacguucaucucgcacccgccguggcuccgaccuuuccuggcgagcagcuguuauucuuuagauccacuaugccagguuguagcggguaccccaacaugaaucuggauugccuccuuccucaagaauggguacagcacuucuaucaggaggcggcacccgcccagucggacgucgcucuguugagguuugugaacccagauacgggccggguucuauucgaguguaagcugcacaaaucuggauacgugacagucgcccauaccggcccucacgaccucgugauucccccaaauggguauuuucguuucgauuccuggguaaaccaauuuuacacucuggcaccgaugggaaauggugccggccgcagaagguga

SEQ ID NO: 21453 - RNA, 1614 nt, Artificial Sequence
  derived and/or modified sequence opt3 from VP1__Norovirus_and/or_Norovirus-like__KF806505
augaagauggccagcaacgacgcuucccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucguuguggacguccgccaacuggagccagugcuuauaccccugccugaugugcgaaacaauuuuuaucacuacaaccagucaaaggacccaaccaucaaauugauugcuaugcucuauacaccccugcgugccaauaacgcgggggaagaugucuucacuguuagcugcagagugcugaccaggccgaguccugacuuugauuucaucuuucucguacccccaacaguggagucccggucuaagccuuucaccguccccauuuuaacuguggaagagaugacaaacagccgcuuuccaaucccccuggagaaacuuuucaccggaccuuccggugccuucguugugcagccacagaauggcagauguacgacugacggggucuugcugggaaccacacaacuaucaccggugaacauaugcacuuuuaggggcgaucucacccauuucacagguaccagugaauacgcaaugaaucuggcuagccagaacuggaauaacuaugaccccacggaggaaauuccugccccacuuggggcucccgauuuuguaggaaagauccggggcaugcugacucagacaacccgccgagacggcucuacuagagggcacagggccacauuguccaccggaucagcacauuucacgccuaagcucgguagcauucgguuuaguaccgacacaaauaacgauuucgaggccggccagaauacuaaauuuaccccaguugggguguuccaagaaggagacaaccaccagaaugagccccagcaauggguccugccgaacuacucuggcgcuacagcgcacaaugugcauuuagccccugcagucgcuccagccuuucccggugagcagcuccuguucuuucguuccacuaugccuggguguggcggauaccccaacaugaaucuugauugccuguugccacaggaaugggugcagcacuucuaucaagaggcagccccugcucagagcgacguugcccuacugcgcuuugugaaccccgauaccucgagaguacucuucgaauguaagcugcauaaaucuggcuacgucacaguggcacacaccgggcagcacgaccuuguuaucccaccgaacggauauuucagguuugauuccugggugaaucaguucuacacucuggcgccuauggguaacggcacggggcggcgacgcuga

SEQ ID NO: 21454 - RNA, 1614 nt, Artificial Sequence
  derived and/or modified sequence opt3 from VP1__Norovirus_and/or_Norovirus-like__JQ478407
augaagauggccagcaacgacgcuucccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucacagugccuaucuuaaccgucgaggaaaugagcaauucccgcuuucccauaccacuggagaaacuuuacacgggacccucaagugcguucgugguucagccucagaacgguagauguacuaccgauggcguguugcuggggacaacucaacuaagcgccgucaauauuugcaccuucaggggagacaucacacauauugcaggcucucacgauuauaccaugaaccucgcuucccagaauuggucaaacuacgacccaacggaggaaaucccggcuccccuggguacuccugacuuuguggggaagauccagggaaugcuuacacagaccacucgggaggauggcagcacacgcgcccauaaggccaccguaaguacgggcucuguucacuucaccccaaagcugggguccgugcaauacacaacugacaccaauaacgauuuucagacaggacagaauacuaaauucacccccgucggugugauucaagacggcgggaaccaccagaaugaaccucagcagugggucuugccaaacuauagcggacgaacaggccauaaugugcaccucgcacccgccguugcuccgaccuuuccuggugagcaacuguuauucuuuagaucgacuaugccaggguguucuggcuaccccaacaugaaucuggauugccuccuuccucaggaaugggugcagcauuucuaucaggaggcggcacccgcccaauccgacguagcucuguugagguuugucaacccagauacgggacgggugcuauucgaguguaagcugcacaaaucaggcuacguuacaguggcccacaccgggccucaugaccucgucauacccccaaacggauauuuucguuucgauaguugggugaaucaguuuuacacucuggcaccgauggguaacggcgccgggcgcagaagguga

SEQ ID NO: 21455 - RNA, 1614 nt, Artificial Sequence
  derived and/or modified sequence opt3 from VP1__Norovirus_and/or_Norovirus-like__AB303923
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacucaacaauuaaguugaucgcaaugcucuauacuccacugcgugcuaacaaugccggggaugacguguucaccgucagcugcagaguucugacaaggcccaguccggauuuugacuucauuuuucucgugccucccaccguagaaucccggacuaaaccauucacagugccuaucuuaaccgucgaggaaaugucuaacagccgcuuucccauaccacuggagaaacuuuacacgggacccuccucagcguucgugguucagccucagaaugguagauguacuaccgauggcguguugcuggggacaacucaacuaagugccgucaacauuugcaccuucaggggagacgugacacauaucgcaggcagccacgauuauaccaugaaucucgcuucucagaacuggaauaacuacgacccaacggaggaaauuccggcuccccuggguacuccugacuuuguagggaagauccagggaaugcuuacacagaccacucgggaggauggcuccacacgcgcccauaaggccaccguuucaacgggcagcgugcacuucaccccaaagcuggggaguguccaauacacaacugacaccaauaacgauuuucagacaggacagaauacuaaauucacccccgugggugucauccaagacggcaacaaucaccagaacgaaccucagcaguggguguugccaaauuauucugggcgaacaggacauaacguucaccucgcacccgccguggcuccgaccuuuccuggcgagcaacuguuauucuuuagauccacuaugccagguuguagcggguaccccaacaugaaucuggauugccuccuuccucaggaauggguacagcauuucuaucaggaggcggcacccgcccaaucggacgucgcucuguugagguuugugaacccagauacgggccggguucuauucgaguguaagcugcacaaaucuggauacgugacagucgcccacaccggcccucaugaccucgugauucccccaaauggguauuuucguuucgauuccuggguaaaccaguuuuacacucuggcaccgaugggaaauggugccggccgcagaagguga

SEQ ID NO: 21456 - RNA, 1614 nt, Artificial Sequence
  derived and/or modified sequence opt3 from VP1__Norovirus_and/or_Norovirus-like__AF427120
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacucaacaauuaaguugaucgcaaugcucuauacuccacugcgugcuaacaaugccggggaugacguguucaccgucagcugcagaguucugacaaggcccaguccggauuuugacuucauuuuucucgugccucccaccguagaaucccggacuaaaccauucacagugccuaucuuaaccgucgaggaaaugucuaacagccgcuuucccauaccacuggagaaacuuuacacgggacccuccucagcguucauugugcagccucagaaugguagauguacuaccgauggcguuuugcuggggacaacucaacuaagugccgugaacaucugcaccuucaggggagacgucacacauauugcaggcagccacgauuauaccaugaaucucgcuucucagaacuggaauaacuacgacccaacggaggaaaucccggcuccccuggguacuccugacuuuguggggaagauccagggaaugcuuacacagaccacucgggaggauggcuccacacgcgcccauaaggccaccguaucaacgggcagcguucacuucaccccaaagcuggggagugugcaauacacaacugacaccaauaacgauuuucagacaggacagaauacuaaauucacccccgucggugugauucaagacggcaacaaucaccagaacgaaccucagcagugggucuugccaaauuauucugggcgaacaggacauaacgugcaccucgcacccgccguugcuccgaccuuuccuggcgagcaacuguuauucuuuagauccacuaugccagguuguagcggguaccccaacaugaaucuggauugccuccuuccucaggaaugggugcagcauuucuaucaggaggcggcacccgcccaaucggacguagcucuguugagguuugucaacccagauacgggccgggugcuauucgaguguaagcugcacaaaucuggauacguuacaguggcccacaccggcccucaugaccucgucauacccccaaauggguauuuucguuucgauuccugggugaaccaguuuuacacucuggcaccgaugggaaauggugccggccgcagaagguga

SEQ ID NO: 21457 - RNA, 1614 nt, Artificial Sequence
  derived and/or modified sequence opt3 from VP1__Norovirus_and/or_Norovirus-like__AY532134
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaauaucauagaccccuggaucagaaacaauuucguccaggcuccugguggcgaauuuacagugucaccaaggaacgcacccggggagauucuuuggagugccccucugggaccagauuugaaucccuacuuaagccaccuggcucggauguauaacggcuacgccgguggguucgaaguucaggugauccuagcgggaaaugcauuuacugccggcaaaauuaucuucgcugccgucccuccaaacuuuccgacggagggccucucccccucucaggugaccauguucccucauauaaucguagacguucgccaacuggagccagugcuuauuccccugccugauguccgaaauaacuuuuaucacuacaaucagucgaacgacucaacaaucaaguugauugcaaugcucuauacuccacugcgugcuaacaaugccggggaugacguguucaccgugagcugcagaguccugacaaggcccaguccggauuuugacuucaucuuucucguuccucccaccguggaaucccggauaaaaccauucacuguaccuauuuuaacaguggaggaaaugucuaacagccgcuuucccaucccacuggagaaacuuuacaccggacccuccucagcguucgucgugcagccucagaaugguagauguacgacugauggcguuuugcuggggaccacacaacuaagugccgugaacauuugcacuuucaggggagacgucacccauaucgcaggcagccacgauuauacaaugaaucucgcuucucagaacuggaauaacuacgacccaaccgaggaaaucccggcuccccuggguacgccugacuuuguggggaagauucagggaguacuuacucagacaacccgggaggauggcuccacucgcgcccauaaggccacaguuucaaccggcagcgugcacuucacgccaaagcuggggaguguccaauacaccacagacacuaauaacgauuuucagaccggacagaauacaaaauucacucccgugggugucauacaagacggcaacaaucaccagaacgaaccucagcaguggguguugccaaauuauucugggcgagcaggacauaacguucaccucgcccccgcuguggcgccgaccuuuccuggcgagcaacuguuauucuuuagauccacaaugccagguuguagcggguaccccaacaugaaucuggauugccuccuuccucaggaauggguacagcauuucuaucaggaggcagcccccgcucaaucggacgucgcccuguugagguuugugaacccagauaccggccggguucuauucgaguguaagcugcacaaaucuggauacgugacugucgcacacacgggcccucaugaccucgugauucccccaaauggguauuuucguuucgauuccuggguaaaccaguuuuacgcccuggcuccgaugggaaauggugccggccgcagaagguga

SEQ ID NO: 21458 - RNA, 1614 nt, Artificial Sequence
  derived and/or modified sequence opt3 from VP1__Norovirus_and/or_Norovirus-like__AY532116
augaagauggccagcaacgacgcuaaucccuccgauggcucuaccgcaaaccuggugccugaggucaauaacgaaguuauggcccucgagccagugguaggggcggcuaucgccacaccgguggcaggacagcaaaaugucauugaccccuggauaagaaacaauuucgugcaggccccugguggcgaauuuacuguuucaccaaggaacgcucccggggagauccuuuggagugcaccucugggaccagauuugaaucccuacuuaagccaccuggcccggauguauaacggcuacgcugguggguucgaagugcaggucauucuagccggaaaugcguuuacggcaggcaaaaucauuuucgccgcugugccuccaaacuuuccgaccgagggccucucccccucucagguaacaauguucccucauaucauaguugacgugcgccaacuggagccaguccuuaucccccugccugaugugcgaaauaacuuuuaucacuacaaucagucgaacgacucaacuauuaaguugaucgccaugcucuauaccccacugcgugcaaacaaugcuggggaugacguguucacagucagcugcagaguucugaccaggcccaguccggauuuugacuucauuuuucucgugccucccacuguagaaucccggacaaaaccauucaccgugccuaucuuaacggucgaggaaaugucuaacagccgcuuucccauaccacuggagaaacuuuacacuggacccuccucagccuucgugguucagccucagaaugguagauguaccacagauggcguguugcuggggacuacccaacuaagugcggucaacauuugcacauucaggggagacgugacccauaucgccggcagccacgauuauacgaugaaucucgcaucucagaacuggaauaacuacgacccaacugaggaaauuccggcuccccuggguacaccugacuuuguagggaagauccagggaaugcuuacccagacuacacgggaggauggcuccacccgcgcccauaaggcuacgguuucaaccggcagcgugcacuucacaccaaagcuggggaguguccaauacacuaccgacacaaauaacgauuuucagacuggacagaauaccaaauucacacccgugggugucauccaagacggcaacaaucaccagaacgaaccucagcaguggguguugccaaauuauucugggcgaaccggacauaacguucaccucgcccccgcaguggccccgacuuuuccuggcgagcaacuguuauucuuuagauccacgaugccagguuguagcggguaccccaacaugaaucuggauugccuccuuccucaggaauggguacagcauuucuaucaggaggcugcgcccgcacaaucggacgucgcccuguugagguuugugaacccagauacaggccggguucuauucgaguguaagcugcacaaaucuggauacgugaccgucgcucacacuggcccucaugaccucgugauucccccaaauggguauuuucguuucgauuccuggguaaaccaguuuuacacccuggccccgaugggaaauggugcaggccgcagaagguga

SEQ ID NO: 21459 - RNA, 1614 nt, Artificial Sequence
  derived and/or modified sequence opt3 from VP1__Norovirus_and/or_Norovirus-like__AY532112
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaauauuauagaccccuggaucagaaacaauuucguccaggcuccugguggcgaauuuacagugucaccaaggaacgcacccggggagauucuuuggagugccccucugggaccagauuugaaucccuacuuaagccaccuggcucggauguauaacggcuacgccgguggguucgaaguucaggugauccuagcgggaaaugcauuuacugccggcaaaauuaucuucgcugccgucccuccaaacuuuccgacggagggccucucccccucucaggugaccauguucccucauauaaucguagacguucgccaacuggagccagugcuuauuccccugccugauguccgaaauaacuuuuaucacuacaaucagucgaacgacucaacaaucaaguugauugcaaugcucuauacuccacugcgugcuaacaaugccggggaugacguguucaccgugagcugcagaguccugacaaggcccaguccggauuuugacuucaucuuucucguuccucccaccguggaaucccggacuaaaccauucacagcgccuauauuaaccguagaggaaaugucuaacagccgcuuucccauuccacuggagaaacuuuacacgggacccuccucagccuucgugguccagccucagaaugguagauguacuaccgauggcguguugcuggggacaacucaacuaagugcaguuaacaucugcaccuucaggggagacgugacacauauugcuggcagccacgauuauaccaugaaucucgccucucagaacuggaauaacuacgacccaacggaggaaaucccggcuccccuggguacuccugacuuugucgggaagauccagggaaugcuuacacagaccacucgggaggauggcuccacacgcgcccauaaggcaaccgugucaacgggcagcguacacuucaccccaaagcuggggaguguucaauacacaacugacaccaauaacgauuuucagacaggacagaauacuaaauucacccccgugggugucauucaagacggcaacaaucaccagaacgaaccucagcaguggguguugccaaauuauucugggcgaacaggacauaacguccaccucgcccccgcuguggcgccgaccuuuccuggcgagcaacuguuauucuuuagauccacuaugccagguuguagcggguaccccaacaugaaucuggauugccuccuuccucaggaauggguucagcauuucuaucaggaggcagcccccgcucaaucggacguggcccuguugagguuuguaaacccagauacgggccggguccuauucgaguguaagcugcacaaaucuggauacgugacaguugcacacaccggcccucaugaccucgugauacccccaaauggguauuuucguuucgauuccugggucaaccaguuuuacacucuggccccgaugggaaauggugcuggccgcagaagguga

SEQ ID NO: 21460 - RNA, 1614 nt, Artificial Sequence
  derived and/or modified sequence opt3 from VP1__Norovirus_and/or_Norovirus-like__KX514275
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaugacguguucacugucagcugcagaguucugaccaggcccaguccggauuuugacuucauuuuucucgugccucccacaguagaaucccggaccaaaccauucucugugccuaucuuaacugucggagagaugacaaacagccgcuuucccauaaaucuggaaagacuuuucaccgguccauccucagccaacgugguucagccccagaaugggagguguacgauugauggcgaguugcugggaacuacccaacuaaguagcgugaacaucugcacauuccggggcgacgucacucauauugguucuacccaccauuggacaaugaaucucgcauccccuaacuggaauaacuacgauccaaccgaggaaacgccggcuccccuggggacuccugacuuugugggaaagauccacggcaugcuuacacagaccacucaggagaauggcucaacacgcgcccaccgagcuaccguauauguugggagcgccgacuucacgccaaaacugggaaaggugcaguuugaaaccgauacagaggacgauuuggcaaucagacaaaacacuaaguucacccccgucggugugauucagaguucugaccaucacagggaugaaccucagcaauggcggcucccaaauuacuccggcgccaacacauuuaauguccaucuggcucccgcgguggcaccgaacuucccuggggagcaguuacuguuuuuccguagcacucucccaggauguggcggucaccccaacauggaccuugauugccuguugccucaggaguggguucagcacuuuuaccaagaagccgcucccgcccagucggacguggcacuacugcgcuucguaaauccagauaccucuagaguccucuuugaguguaaacugcauaaguccggguaugugacaguugcccacaccggccaguacgaccuugugcugccuucaaacggauauuucagguuugauaguugggucaaucaguucuacacuuuggcucccaugggcaacgggacgggacggcgacgcuga

SEQ ID NO: 21461 - RNA, 1614 nt, Artificial Sequence
  derived and/or modified sequence opt3 from VP1__Norovirus_and/or_Norovirus-like__KF806510
augaagauggccagcaacgacgcuucccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucguuguggacguccgccaacuggagccagugcuuauaccccugccugaugugcgaaacaauuuuuaucacuacaaccagucaaaggacccaaccaucaaauugauugcuaugcucuauacaccccugcgugccaauaacgcgggggaagaugucuucacuguuagcugcagagugcugaccaggccgaguccugacuuugauuucaucuuucucguacccccaacaguggagucccggucuaagccuuucaccguccccauuuuaacuguggaagagaugacaaacagccgcuuuccaaucccccuggagaaacuuuucaccggaccuuccggugccuucguugugcagccacagaauggcagauguacgacugacggggucuugcugggaaccacacaacuaucaccggugaacauaugcacuuuuaggggcgaucucacccauuucacagguaccagugaauacgcaaugaaucuggcuagccagaacuggaauaacuaugaccccacggaggaaauuccugccccacuuggggcucccgauuuuguaggaaagauccggggcaugcugacucagacaacccgccgagacggcucuacuagagggcacagggccacauuguccaccggaucagcacauuucacgccuaagcucgguaauauucgguuuagcaccgacacaaacaaugauuucgaggccggccagaacacuaaauuuaccccaguugggguguuccaagaaggagacaaucaccagaacgagccccagcaauggguccugccgaauuacaguggcgcuacagcgcacaacgugcauuuagccccugcagucgcuccagccuuucccggugagcagcuccuguucuuucguucuacuaugccuggguguggcggauaccccaauaugaaccuugauugccuguugccacaggaaugggugcagcacuucuaucaagaggcagccccugcucaguccgacguugcccuacugcgcuuugugaaccccgauaccagcagaguacucuucgaauguaagcugcauaaaucgggcuacgucacaguggcacacaccgggcagcacgaccuuguuaucccaccgaauggauauuucagguuugauucuugggugaaccaguucuacacucuggcgccuauggguaauggcacggggcggcgacgcuga

SEQ ID NO: 21462 - RNA, 1614 nt, Artificial Sequence
  derived and/or modified sequence opt3 from VP1__Norovirus_and/or_Norovirus-like__EU078410
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcagacuauucuagcgggaaacgcauuuacggccggcaaaaucauuuucgcugccgucccuccaaauuuuccgaccgagggccucucucccucacaggugacaauguucccucauaucauaguagacguucgccaacuggagccagugcuuaucccccugccugauguccgaaacaauuuuuaucacuacaaccagucgaaugacccaacuauuaaguugaucgcaaugcucuauacaccccugcgugcuaacaacgccggggaugacguguucaccgugagcugcagaguccugaccaggccgaguccugauuuugacuucauuuuucucguucccccaacuguggaaucccggacaaaaccuuucaccguacccaucuuaacgguggaggaaaugucuaauagccgcuuuccaauaccccuggagaaacuuuacacuggaccuuccucagcguucgucgugcagccacagaacgguagauguaccacagauggcguuuugcuggggacuacccaacuaagugccgugaauauuugcacauucaggggagacgucacccauaucgcaggcagccacgauuauacgaugaaccucgcuucucagaauuggaacaauuacgacccgacugaggaaauucccgccccucuggguacaccagacuuuguggggaagauccagggaaugcuuacccagacuacacgggaggauggcuccacccgcgcucauaaggccacgguaucaaccggcagcguucacuucacacccaagcuggggagugugcaauacacuaccgacacaaacaaugauuuucaggcaggacagaacacuaaauucaccccugucggugugauccaagacggcaauaaccaccagaaugaaccacagcagugggucuugcccaacuauucugggcgaacaggacauaaugugcaccucgccccggcuguugcgccuaccuuuccaggcgagcaacuguuauucuuuagauccacuaugcccgguuguagcggguacccuaacaugaaccuggauugccuccuuccccaggaaugggugcagcauuucuaucaggaggcagccccagcucaaucggacguagcccuguugagguuugucaauccugauacgggccgggugcuauucgaguguaagcugcacaaaucuggauacguuacaguggcacacaccggcccccaugaccucgucauuccaccgaacggguauuuucguuucgauuccugggugaaucaguuuuacacucuggccccuaugggaaacgguaccggccgcagaagguga

SEQ ID NO: 21463 - RNA, 1614 nt, Artificial Sequence
  derived and/or modified sequence opt3 from VP1__Norovirus_and/or_Norovirus-like__AF427123
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacucaacaauuaaguugaucgcaaugcucuauacuccacugcgugcuaacaaugccggggaugacguguucaccgucagcugcagaguucugacaaggcccaguccggauuuugacuucauuuuucucgugccucccaccguagaaucccggacuaaaccauucacagugccuaucuuaaccgucgaggaaaugucuaacagccgcuuucccauaccacuggagaaacuuuacacgggacccuccucagcguucgugguucagccucagaaugguagauguacuaccgauggcguguugcuggggacaacucaacuaagugccgucaacauuugcaccuucaggggagacgugacacauaucgcaggcagccacgauuauaccaugaaucucgcuucucagaacuggaauaacuacgacccaacggaggaaauuccggcuccccuggguacuccugacuuuguagggaagauccagggaguucuuacacagaccacucgggaggauggcuccacacgcgcccauaaggccaccgugucaacgggcagcguccacuucaccccaaagcuggggagugugcaauacacaacugacaccaauaacaauuuucagacaggacagaacacuaaauucacccccgucggugugauccaagauggcaauaaccaccagaaugaaccucagcaguggguuuugccaaacuauucugggcgaacaggacauaacgugcaccucgcacccgccguagcuccgaccuuuccuggcgagcaacuguuauucuuuagauccacuaugccagguuguagcggguaccccaauaugaaccuggacugccuccuuccucaggaauggguccagcauuucuaucaggaggcggcacccgcccaaucggauguggcucuguugagguuuguuaauccagacacgggccgggugcuauucgaguguaagcugcacaaaucuggauacgucacaguggcccacaccggcccucaugaucucguaauucccccaaacggguauuuucguuucgacuccugggugaaucaguuuuacacucuggcaccgaugggaaacggugccggccgcagaagguga

SEQ ID NO: 21464 - RNA, 1614 nt, Artificial Sequence
  derived and/or modified sequence opt3 from VP1__Norovirus_and/or_Norovirus-like__AY532135
augaagauggccagcaacgacgcuaaucccccugauggcuccaccgcaaaccuggugccagaggucaauaacgaaguuauggcccucgagccggugguaggggcggcuaucgccgcacccguggccggacagcaaaauauuauagacccuuggaucagaaacaauuucguccaggcuccagguggcgaauuuacagugucucccaggaacgcaccuggggagauucuuuggucagccccacugggacccgauuugaauccuuacuuaagucaccuggcucggauguauaacggcuacgccgguggguucgaaguucaggugauccuagcgggaaaugcauuuacugccggcaaaauuaucuucgcugccgucccaccgaacuuucccacggagggccucagcccuucccaggugaccauguucccacauauaaucguagacguucgccaacuggagcccgugcuuauuccucugccagauguccgaaauaacuuuuaucacuacaaucagucuaacgacucgacaaucaaguugauugcaaugcucuauacuccccugcgugcuaacaaugccggggaugacguguucaccgugucaugcagaguccugacaaggccgagcccugauuuugacuucaucuuucucguucccccaaccguggaaagucggacuaaaccuuucacaguacccauauuaaccguggaggaaauguccaacucucgcuuuccaauuccccuggagaaacuuuacacgggaccuagcuccgcguucgucgugcagccacagaaugguagauguacuaccgauggcguuuugcuggggacaacucaacuaucagccgugaacaucugcaccuucaggggagacgucacacauauugcaggcagucacgauuauaccaugaaucucgcuagccagaacuggaauaacuacgacccgacggaggaaauccccgccccucuggguacuccagacuuuguggggaagauccagggaguacuuacacagaccacucgggaggauggcucuacacgcgcucauaaggccaccguuuccacgggcucagugcacuucacccccaagcuggggagcguccaauacacaacugacaccaauaacgauuuucagacaggacagaauacuaaauucaccccugugggugucauucaagacggcaacaaucaccagaacgaaccacagcaguggguguugcccaauuauagugggcgaacaggacauaacguucaccucgcaccggccguggcuccuaccuuuccaggcgagcaacuguuauucuuuagaucuacuaugcccgguuguuccggguacccuaacaugaaucuggauugccuccuuccccaggaauggguacagcauuucuaucaggaggcggcaccagcccaaagcgacgucgcucuguugagguuugugaacccugauacgggccggguucuauucgaguguaagcugcacaaaucgggauacgugacagucgcccacaccggcccccaugaccucgugauaccaccgaauggguauuuucguuucgauucuuggguaaaccaguuuuacacucuggcaccuaugggaaauggugccggccgcagaagguga

SEQ ID NO: 21465 - RNA, 1614 nt, Artificial Sequence
  derived and/or modified sequence opt3 from VP1__Norovirus_and/or_Norovirus-like__AY532125
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucaucgaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaagugaucuucgcugccguaccuccaaacuuuccgacggagggccucucccccucucagguuaccauguucccucauauuaucguggacguccgccaacuggagccagugcuuauaccccugccugaugugcgaaauaacuuuuaucacuacaaucagucgaacgacucaacaaucaaguugauugcaaugcucuauacuccacugcgugcuaacaaugccggggaugacgucuucaccguuagcugcagagugcugacaaggcccaguccggauuuugacuucaucuuucucguaccucccaccguggaaucccggacuaaaccauucacagucccuauuuuaaccguggaggaaaugucuaacagccgcuuucccaucccacuggagaaacuuuacacgggacccuccucagcguucguugugcagccucagaaugguagauguacuaccgauggcgucuugcuggggacaacucaacuaagugccgugaacauaugcaccuucaggggagacguaacacauauugcaggcagccacgauuauaccaugaaucucgcuucucagaacuggaauaacuacgacccaacggaggaaaucccggcuccccuggguacuccugacuuuguugggaagauucagggaaugcuuacacagaccacucgggaggauggcuccacacgcgcccauaaggccaccgugucaacgggcagcguccacuucaccccaaagcuggggagugugcaauacacaacugacaccaauaacgauuuucagacaggacagaauacuaaauucacccccgucggugugauccaagacggcaacaaucaccagaacgaaccucagcaguggguuuugccaaauuauucugggcgaacaggacauaacgugcaccucgcacccgccguagcuccgaccuuuccuggcgagcaacuguuauucuuuagauccacuaugccagguuguagcggguaccccaacaugaaucuggauugccuccuuccucaggaauggguccagcauuucuaucaggaggcggcacccgcccaaucggacguggcucuguugagguuuguuaacccagauacgggccgggugcuauucgaguguaagcugcacaaaucuggauacgucacaguggcccacaccggcccucaugaccucguaauucccccaaauggguauuuucguuucgauuccugggugaaccaguuuuacacucuggcaccgaugggaaauggugccggccgcagaagguga

SEQ ID NO: 21466 - RNA, 1614 nt, Artificial Sequence
  derived and/or modified sequence opt3 from VP1__Norovirus_and/or_Norovirus-like__AJ277619
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucaucgaccccuggauaagaucaaacuucgugcaggcuccugguggcgaauuuacaguuaguccaaggaaugcacccggggagauccuuuggagcgccccucugggaccagauuugaaccccuacuuaucccaccuggcucggauguauaauggcuacgccggugggcuagaagugcaggucgugcucgcgggaaacgcauucacugccggcaaaauuaucuuugcugccguaccuccaaauuucccgacggagggccugucucccucgcagguuaccauguuuccucauauuaucguggacguccgccaacuugagccagugcugauacccuugccugaugugcgaaacaauuucuaucacuacaaccagucaaaugacagcacaaucaagcucauugcaaugcuguauacuccacugcgugcuaacgaugccggggacgaugucuuuaccguuaguugcagagugcucacaaggcccuccccggacuucgauuuuaucuucuuaguaccucccaccguggaaucucggacuaaaccauuuacagucccuauucugaccguggaggaaaugagcaacucccgcuuccccaucccacuugagaaguuguacacgggacccucaagugcguuuguugugcagccucagaaugguagauguacuaccgacggcguccugcuagggacaacucaacucagcgccgugaacauaugcaccuucaggggagauguaacacauauugcaggcucucacgacuauaccaugaaucuggcuucccagaacuggaauaacuacgacccaacggaggaaaucccggcuccccuugguacuccugauuucguugggaaaauucagggaaugcugucacagacaacccggggcgacgauagcacucgcgcccauaaggccacagugaguaccggcucuguccacuuuacgccaaaguugggguccgugcaauacaccacagacacuaauaacgauuucgagaccggacagaauacaaaauuuacucccgucggugugauccaggacggcaacaaucaccaaaacgaaccucagcaguggguucucccaaauuauagcgggcgaaccggacauaacgugcaccuggcacccgccguagcuccgacauucccuggcgagcaguuacuguuuuucagaucgaccaugccagguuguucuggguaccccaauaugaaccucgauugccuucugccucaagaauggguccagcauuuuuaucaggaggcggcacccgcccaguccgacguggcuuugcuaagguucguuaacccagauacuggccgggugcuguuugaguguaagcuccacaaaucaggauacgucacgguggcccacacaggcccucaugaccugguaauucccccaaauggguauuuccguuuugauaguugggugaaccaacuuuacacccuggcaccgaugggaaauggugccggccgcagaagguga

SEQ ID NO: 21467 - RNA, 1614 nt, Artificial Sequence
  derived and/or modified sequence opt3 from VP1__Norovirus_and/or_Norovirus-like__AF080556
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacucaacaauuaaguugaucgcaaugcucuauacuccacugcgugcuaacaaugccggggaugacguguucaccgucagcugcagaguucugacaaggcccaguccggauuuugacuucauuuuucucgugccucccaccguagaaucccggacuaaaccauucacagugccuaucuuaaccgucgaggaaaugucuaacagccgcuuucccauaccacuggagaaacuuuacacgggacccuccucagcguucgugguucagccucagaaugguagauguacuaccgauggcguguugcuggggacaacucaacuaagugccgucaacauuugcaccuucaggggagacgugacacauaucgcaggcagccacgauuauaccaugaaucucgcuucucagaacuggaauaacuacgacccaacggaggaaauuccggcuccccuggguacuccugacuuuguagggaagauccagggaaugcuuacacagaccacucgggaggauggcuccacacgcgcccauaaggccaccguuucaacgggcagcgugcacuucaccccaaagcuggggaguguccaauacacaacugacaccaauaacgauuuucaggcaggacagaauacaaaauucacucccgugggugucauccaagacggcaacaaucaccagaacgaaccucagcaguggguguugccaaauuauucugggcgaaccggacauaacguucaccucgcccccgcuguggcgccgacauuuccuggcgagcaacuguuauucuuuagauccaccaugccagguuguagcggguaccccaacaugaaucuggauugccuccuuccucaggaauggguacagcauuucuaucaggaggcagcccccgcucaaucggacgucgcccuguugagguuugugaacccagauacuggccggguucuauucgaguguaagcugcacaaaucuggauacgugacggucgcacacacaggcccucaugaccucgugauucccccaaauggguauuuucguuucgauuccuggguaaaccaguuuuacacccuggccccgaugggaaauggugcuggccgcagaagguga

SEQ ID NO: 21468 - RNA, 1614 nt, Artificial Sequence
  derived and/or modified sequence opt3 from VP1__Norovirus_and/or_Norovirus-like__AF080550
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgucagacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucacagugccuaucuuaaccgucgaggaaaugagcaauucccgcuuucccauaccacuggagaaacuuuacacgggacccucaagugcguucgugguucagccucagaacgguagauguacuaccgauggcguguugcuggggacaacucaacuaagcgccgucaauauuugcaccuucaggggagacgugacacauaucgcaggcucucacgauuauaccaugaaccucgcuucccagaauuggaacaauuacgacccaacggaggaaauuccggcuccccuggguacuccugacuuuguagggaagauccagggaaugcuuacacagaccacucgggaggauggcucaacacgcgcccauaaggccaccguuagcacgggcagugugcacuucaccccaaagcuggggucuguccaauacacaacugacaccaacaaugauuuucagacaggacagaacacuaaauucacccccgugggugucauccaagacggcaauaaccaccagaaugaaccucagcaguggguguugccaaacuauuccgggcgaacaggacauaauguucaccucgcacccgccguggcuccgaccuuuccuggcgagcaacuguuauucuuuagaagcacuaugccagguuguucgggguaccccaacaugaaccuggauugccuccuuccucaggaauggguacagcauuucuaucaggaggcggcacccgcccaaucugacgucgcucuguugagguuugugaauccagauacgggccggguucuauucgaguguaagcugcacaaauccggauacgugacagucgcccacaccggcccucaugaccucgugauucccccaaacggguauuuucguuucgauucauggguaaaucaguuuuacacucuggcaccgaugggaaacggugccggccgcagaagguga

SEQ ID NO: 21469 - RNA, 1614 nt, Artificial Sequence
  derived and/or modified sequence opt3 from VP1__Norovirus_and/or_Norovirus-like__EU078407
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacucaacaauuaaguugaucgcaaugcucuauacuccacugcgugcuaacaaugccggggaugacguguucaccgucagcugcagaguucugacaaggcccaguccggauuuugacuucauuuuucucgugccucccaccguagaaucccggacuaaaccauucacagugccuaucuuaaccgucgaggaaaugucuaacagccgcuuucccauaccacuggagaaacuuuacacgggacccuccucagcguucgugguucagccucagaaugguagauguacuaccgauggcguguugcuggggacaacucaacuaagugccgucaacauuugcaccuucaggggagacgugacacauaucgcaggcagccacgauuauaccaugaaucucgcuucucagaacuggaauaacuacgacccaacggaggaaauuccggcuccccuggguacuccugacuuuguagggaagauccagggaaugcuuacacagaccacucggggcgauggcuccacacgcgcccauaaggccaccguuucaacggggagcgugcacuucaccccaaagcugggaaguguccaauuuacaacugacaccaauaacgauuuccagacaggucagaauacuaaauuuacccccgugggcgucauccaagacggggauaaccaccagaaugagccucagcaguggguguugccaaacuacucuggacgaacaggccauaauguucaccucgcacccgccguggcuccgaccuucccuggugaacaacuguuauuuuucagauccacuaugccaggguguagcggcuaucccaacaugaaccuggacugccuccuuccucaggaguggguacagcauuuuuaccaggaagcggcacccgcccaaucggaugucgcucuguugagguucgugaauccagacacgggacggguucuauuugaguguaagcugcacaaaucuggcuaugugacagucgcccacaccgggccucaugaucucgugauucccccaaacggauacuuccguuuugacuccuggguaaaucaguucuauacucuggcaccgauggguaacggcaccgggcgcagaagguga

SEQ ID NO: 21470 - RNA, 1614 nt, Artificial Sequence
  derived and/or modified sequence opt3 from VP1__Norovirus_and/or_Norovirus-like__AB083781
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaucaaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucacagugccuaucuuaaccgucgaggaaaugagcaauucccgcuuucccauaccacuggagaaacuuuacacgggacccucaagugcguucgugguucagccucagaacgguagauguacuaccgauggcguguugcuggggacaacucaacuaagcgccgucaauauuugcacccucaggggagacgugacacauaucgcaggcucucacgauuauaccaugaaccuggcuucccagaauuggaacaauuacgacccaacggaggaaauuccggcuccccuugguacuccugacuucguagggaagauccagggaaugcugucacagacaacccggggcgauggcagcacucgcgcccauaaggccacaguuaguaccgggucugugcacuuuacgccaaaguugggauccguccaauacaccacagacacuaacaaugauuucgagaccggucagaacacaaaauuuacucccgugggcgucauccaggacgggaauaaccaccaaaaugaaccucagcagugggugcucccaaacuauagcggacgaaccggccauaauguucaccuggcacccgccguggcuccgacauucccuggugagcaguuacuguuuuucagaucgaccaugccaggguguucuggcuaccccaacaugaaccucgauugccuucugccucaagaauggguacagcauuuuuaucaggaggcggcacccgcccaguccgacgucgcuuugcuaagguucgugaauccagauacuggacggguucuguuugaguguaagcuccacaaaucaggcuacgugacggucgcccacacagggccucaugaccuggugauucccccaaacggauauuuccguuuugauaguuggguaaaucaauucuacacccuugcaccgauggguaacggcgccgggcgcagaagguga

SEQ ID NO: 21471 - RNA, 1614 nt, Artificial Sequence
  derived and/or modified sequence opt3 from VP1__Norovirus_and/or_Norovirus-like__AF427122
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacucaacaauuaaguugaucgcaaugcucuauacuccacugcgugcuaacaaugccggggaugacguguucaccgucagcugcagaguucugacaaggcccaguccggauuuugacuucauuuuucucgugccucccaccguagaaucccggacuaaaccauucacagugccuaucuuaaccgucgaggaaaugucuaacagccgcuuucccauaccacuggagaaacuuuacacgggacccuccucagcguucgugguucagccucagaaugguagauguacuaccgauggcguguugcuggggacaacuaggcuaagugccgucaacauuugcaccuuccggggagacgugacacauaucgcaggcagccgcgauuauaccaugaaucucgcuucucaaaacuggaauaacuacgacccaacggaggaaauuccggcuccccuggguacuccugacuuuguagggaagauccagggaguucuuacacagaccacucgagaggauggcuccacaagagcccacaaggccaccgugucaacgggcagcguccauuucaccccaaagcuggggagugugcaguacacaacugacaccaauaacgauuuucaaacaggacagaauacuaaauucacccccgucggugugauccaggacggcaacaaucaccaaaacgaaccucagcaguggguuuugccaaauuauucugggaggacaggacacaacgugcaucucgcacccgccguagcuccgaccuuuccuggcgagcagcuguuauucuuucgguccacuaugccagguuguagcggguaccccaacaugaaucuggauugccuccuuccucaagaauggguccagcacuucuaucaggaggcggcacccgcccagucggacguggcucuguugcguuuuguuaacccagauacgggccgcgugcuauucgaguguaagcugcauaaaucuggauacgucacaguggcccacaccggcccucacgaccucguaauucccccaaauggguauuuuagauucgauuccugggugaaccaauuuuacacucuggcaccgaugggaaaugguguuggcaggcggcgauga

SEQ ID NO: 21472 - RNA, 1614 nt, Artificial Sequence
  derived and/or modified sequence opt3 from VP1__Norovirus_and/or_Norovirus-like__AY532133
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugagcccagauuugaaucccuacuuaucccaccuggcucggauguauaacggauacgccggcgguuucgaagugcaggucauucuagcggggaaugcauuuacugccggaaaaaucauuuucgcugccgugccuccaaacuuuccgacggagggccucucucccucgcagguaaccauguucccucauaucauaguugacgugcgccaacuggagccaguccuuaucccccugccugaugugcgaaauaacuuuuaucacuacaaucagucaaacgacagcacaauuaaguugaucgcaaugcucuauacuccacugcgugcuaacaaugccggcgaugacguguucaccgucaguugcagaguucugacaaggcccuccccggauuuugacuucauuuuucucgugccucccaccguagaaucucggaucaaaccauucacugugccuauauuaacagucgaggaaaugagcaacucccgcuuucccauuccacuggagaaacuuuacaccgggcccucaagugcguucgugguucagccucagaauggaagauguacgacugaugguguguugcugggcaccacacaacuaagcgccgucaacaucugcacuuucaggggagacgugacccauauugcagggucucacgauuauacaaugaaucucgcuucccagaacuggaauaacuacgacccaaccgaggaaaucccggcuccccugggcacgccugacuuuguagguaagauccaggggaugcuuacucagacaacccgggaggauggaucaacucgcgcccauaaggccacaguuagcaccggcagugugcacuucacgccaaagcugggcucuguccaauacaccacagacacuaauaacgauuuucagaccgggcagaauacaaaauucacucccgugggagucauucaagacgguaacaaucaccagaacgaaccucagcaguggguguugccaaauuauuccggccgaaccgggcauaacguucaccucgcacccgccguggcuccgacauuuccuggagagcaacuguuauucuuuagaagcaccaugccaggcuguucggguuaccccaacaugaaucuggauugccuccuuccucaggaauggguacagcauuucuaucaggaggcggcacccgcccaaucugacgucgcucuguugagguuugugaacccagauacugggcggguucuauucgaguguaagcugcacaaauccggcuacgugacggucgcccacacaggaccucaugaccucgugauacccccaaauggcuauuuucguuucgauucauggguaaaccaguuuuacacccuggcaccgauggggaauggagccggucgcagaagguga

SEQ ID NO: 21473 - RNA, 1614 nt, Artificial Sequence
  derived and/or modified sequence opt3 from VP1__Norovirus_and/or_Norovirus-like__AY532131
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaauauuauagaccccuggaucagaaacaauuucguccaggcuccugguggcgaauuuacagugucaccaaggaacgcacccggggagauucuuuggagugccccucugggaccagauuugaaucccuacuuaagccaccuggcucggguuuauaacggcuacgccgguggguucgaagugcaggucauccuagcgggaaaugcauuuacugccggcaaaauuaucuucgcugccgugccuccaaacuuuccgacggagggccucucccccucucagguaaccauguucccucauauaaucguugacgugcgccaacuggagccaguccuuauuccccugccugaugugcgaaauaacuuuuaucacuacaaucagucgaacgacucaacaaucaaguugauugcaaugcucuauacuccacugcgugcuaacaaugccggggaugacguguucaccgucagcugcagaguucugacaaggcccaguccggauuuugacuucaucuuucucgugccucccaccguagaaucccggacuaaaccauucacagugccuauauuaaccgucgaggaaaugucuaacagccgcuuucccauuccacuggagaaacuuuacacgggacccuccucagcguucgugguucagccucagaaugguagauguacuaccgauggcguguugcuggggacaacucaacuaagugccgucaacaucugcaccuucaggggagacgugacacauauugcaggcagccacgauuauaccaugaaucucgcuucucagaacuggaauaacuacgacccaacggaggaaaucccggcuccccuggguacuccugacuuuguagggaagauccagggaaugcuuacacagaccacucgggaggauggcuccacacgcgcccauaaggccaccguuucaacgggcagcgugcacuucaccccaaagcuggggaguguccaauacacaacugacaccaauaacgauuuucagacaggacagaauacuaaauucacccccgugggugucauucaagacggcaacaaucaccagaacgaaccucagcaguggguguugccaucuuauuccgggcgaacaggacauaauguucaccucgcacccgccguggcuccgaccuuuccuggcgagcaacuguuauucuuuagaagcacuaugccagguuguucgggguaccccaacaugaaccuggauugccuccuuccucaggaauggguacagcauuucuaucaggaggcggcacccgcccaaucugacgucgcucuguugagguuugugaauccagauacgggccggguucuauucgaguguaagcugcacaaauccggauacgugacagucgcccacaccggcccucaugaccucgugauacccccaaacggguauuuucguuucgauucauggguaaaucaguuuuacacucuggcaccgaugggaaacggugccggccgcagaagguga

SEQ ID NO: 21474 - RNA, 1614 nt, Artificial Sequence
  derived and/or modified sequence opt3 from VP1__Norovirus_and/or_Norovirus-like__AY532121
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaagugaucuucgcugccguaccuccaaacuuuccgacggagggccucucccccucucagguuaccauguucccucauauuaucguggacguccgccaacuggagccagugcuuauaccccugccugaugugcgaaauaacuuuuaucacuacaaucagucgaacgacucaacaaucaaguugauugcaaugcucuauacuccacugcgugcuaacaaugccggggaugacgucuucaccguuagcugcagagugcugacaaggcccaguccggauuuugacuucaucuuucucguaccucccaccguggaaucccggacuaaaccauucacagucccuauuuuaaccguggaggaaaugucuaacagccgcuuucccaucccacuggagaaacuuuacacgggacccuccucagcguucguugugcagccucagaaugguagauguacuaccgauggcgucuugcuggggacaacucaacuaagugccgugaacauaugcaccuucaggggagacguaacacauauugcaggcagccacgauuauaccaugaaucucgcuucucagaacuggaauaacuacgacccaacggaggaaaucccggcuccccuggguacuccugacuuuguugggaagauucagggaacacuuacccagacuacacgggaggauggcuccacccgcgcccauaaggccacggugucaaccggcagcguccacuucacaccaaagcuggggagugugcaauacacuaccgacacaaauaacgauuuucagacuggacagaauaccaaauucacacccgucggugugauccaagacggcaacaaucaccagaacgaaccucagcaguggguuuugccaaauuauucugggcgaaccggacauaacgugcaccucgcacccgccguagcuccgacuuuuccuggcgagcaacuguuauucuuuagauccacgaugccagguuguagcggguaccccaacaugaaucuggauugccuccuuccucaggaauggguccagcauuucuaucaggaggcggcacccgcccaaucggacguggcucuguugagguuuguuaacccagauacaggccgggugcuauucgaguguaagcugcacaaaucuggauacgucaccguggcccacacuggcccucaugaccucguaauucccccaaauggguauuuucguuucgauuccuggaucaaccaguuuuacacccuggcaccgaugggaaauggugccggccgcagaagguga

SEQ ID NO: 21475 - RNA, 1614 nt, Artificial Sequence
  derived and/or modified sequence opt3 from VP1__Norovirus_and/or_Norovirus-like__AY532115
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgacgugcaggucauucuagcgggaaaugcauuuacugccggcaaaaucauuuucgcugccgugccuccaaacuuuccgacggaaggccucucccccucucagguaaccauguucccucauaucauaguugaugugcgccaacuggagccaguccuuaucccccugccugacgugcgaaauaacuuuuaucacuacaaucagucgaacgauucaacaauuaaguugaucgcaaugcucuauacuccacugcgugcuaacaaugccggggacgauguguucaccgucagcugcagaguucugacaaggcccaguccggacuuugauuucauuuuucucgugccucccaccguagagucccggacuaaaccauucacagugccuaucuuaaccgucgaagagaugucuaacagccgcuuucccauaccacuggaaaaacuuuacacgggacccuccucagcguucgugguucagccucagaaugguagauguacuaccgacggcguguugcuggggacaacucaacuaagugccgucaacauuugcaccuucaggggagaugugacacauaucgcaggcagccacgacuauaccaugaaucucgcuucucagaacuggaauaacuacgacccaacggaggagauuccggcuccccuggguacuccugauuuuguagggaagauccagggaaugcuuacacagaccacucgggaagacggcuccacacgcgcccauaaggccaccguuucaacgggcagcgugcacuucaccccaaagcuggggaguguccaauacacaacugauaccaauaacgacuuucagacaggacagaauacuaaauucacccccgugggugucauccaagauggcaacaaucaccagaacgagccucagcaguggguguugccaaauuauucugggcgaacaggacauaacguucaccucgcacccgccguggcuccgaccuuuccuggcgaacaacuguuauucuuuagauccacuaugccagguuguagcggguaccccaacaugaaucuggacugccuccuuccucaggaguggguacagcauuucuaucaggaagcggcacccgcccaaucggaugucgcucuguugagguuugugaacccagacacgggccggguucuauucgaguguaagcugcacaaaucuggauacgugacagucgcccacaccggcccucaugaucucgugauucccccaaauggguauuuucguuucgacuccuggguaaaccaguuuuacacucuggcaccgaugggaaauggugccggccgcagaagguga

SEQ ID NO: 21476 - RNA, 1614 nt, Artificial Sequence
  derived and/or modified sequence opt3 from VP1__Norovirus_and/or_Norovirus-like__KF806530
augaagauggccagcaacgacgcuucccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucguuguggacguccgccaacuggagccagugcuuauaccccugccugaugugcgaaacaauuuuuaucacuacaaccagucaaaggacccaaccaucaaauugauugcuaugcucuauacaccccugcgugccaauaacgcgggggaagaugucuucacuguuagcugcagagugcugaccaggccgaguccugacuuugauuucaucuuucucguacccccaacaguggagucccggucuaagccuuucaccguccccauuuuaacuguggaagagaugacaaacagccgcuuuccaaucccccuggagaaacuuuucaccggaccuuccggugccuucguugugcagccacagaauggcagauguacgacugacggggucuugcugggaaccacacaacuaucaccggugaacauaugcacuuuuaggggcgaucucacccauuucgcagguacacacgaauacgcuaugaaucuggccagucagaacuggaauaacuaugaccccaccgaggaaauuccugcuccacuuggggcccccgauuuuguaggaaagauccggggcguucugacgcagacuacacgccgagacggcagcaccagagggcauagggcaacuuugucuacaggauccgcccacuucaccccuaagcucgguucaauucgguuuagcacggacaccaauaacgauuucgaggcuggccagaauacaaaauuuacuccagugggggucuuccaagacggagauaaccaccagaaugaaccccagcaaugggugcugccgaacuacaguggcgcgaccgcacauaauguccacuuagccccugcuguggccccagcauuucccggugagcagcuccuguucuuucguucuacaaugccuggguguuccggcuaccccaacaugaaucuugacugccuguugccacaggaguggguucagcauuucuaucaagaagccgcuccugcccagagcgauguggcacuacugcgcuuuguaaaccccgacacuucgagaguccucuucgaguguaagcugcacaaaucuggauacgugaccguugcgcacacaggccagcaugaucuugugaucccaccgaacggguauuucagguuugacuccugggucaaucaguucuacacccuggcuccuaugggaaacgguacuggccggcgacgcuga

SEQ ID NO: 21477 - RNA, 1614 nt, Artificial Sequence
  derived and/or modified sequence opt3 from VP1__Norovirus_and/or_Norovirus-like__KF806513
augaagauggccagcaacgacgcuucccccucugauggcucagcagccaaucuggugccugaggucaguaacgaaguuauggcgcucgagccagugguaggggcugccaucgcagccccgguggcuggacagcaaaaugucauugaccccuggauaagaaacaauuucgugcaggcaccugguggcgaauuuaccguuagcccaaggaacgcccccggggagauccuuugguccgcuccucugggaccagauuugaaucccuacuuaucucaccuggcccggauguauaacggcuacgcggguggguucgaagugcaggucauucuagcaggaaaugccuuuacagcuggcaaaaucauuuucgccgcagugccuccaaacuuuccgacugagggccucucgcccucacagguaacgauguucccucauaucguuguggacguccgccaacuggagccagugcuuauaccccugccugaugugcgaaauaacuuuuaucacuacaaucagagcaaggacccaaccaucaaauugauugcuaugcucuauacaccccugcgugccaacaaugcgggggaagaugucuucacuguuaguugcagagugcugaccaggccguccccugacuuugauuucaucuuucucguacccccaacaguggagucucggagcaagccuuucaccguccccauuuuaacuguggaagagaugacaaacucccgcuuuccaaucccccuggagaaacuuuucaccggaccuucaggugccuucguugugcagccacagaacggcagauguacgacugacggggucuugcugggaaccacacaacuaaguccggugaauauaugcacuuuuaggggcgaucucacccauuucacagguaccagcgaauacgcaaugaaccuggcuucucagaauuggaacaauuaugaccccacggaggaaauuccugccccacuuggggcucccgauuuuguaggaaagauccggggcaugcugacucagacaacccgccgagacggcuccacuagagggcacagggccacauugucaaccggaagcgcacauuucacgccuaagcucgguaguauucgguuuucuaccgacacaaacaaugauuucgaggccucccagaacacuaaauuuaccccaguuggcguguuccaagaaggggacaaucaccagaacgagccccagcaauggguccugccgaauuacagcggagcuacagcgcacaacgugcauuuagccccugcagucgcuccagccuuucccggcgagcagcuccuguucuuucguucgacuaugccugguugugggggcuaccccaauaugaaccuugauugccuguugccacaggaaugggugcagcacuucuaucaagaggcagccccugcucagucugacguugcccuacugcgcuuugugaaucccgauaccuccagaguacucuucgaauguaagcugcauaaaucaggauacgucacaguggcacacaccggccagcacgaccuuguuaucccaccgaacggguauuucagguuugauaguugggugaaccaguucuacacucuggcgccuaugggaaaugguacgggccggcgacgcuga

SEQ ID NO: 21478 - RNA, 1614 nt, Artificial Sequence
  derived and/or modified sequence opt3 from VP1__Norovirus_and/or_Norovirus-like__AY741811
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucaucgaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaagugaucuucgcugccguaccuccaaacuuuccgacggagggccucucccccucucagguuaccauguucccucauauuaucguggacguccgccaacuggagccagugcuuauaccccugccugaugugcgaaauaacuuuuaucacuacaaucagucgaacgacucaacaaucaaguugauugcaaugcucuauacuccacugaaagcuaacaaugccggggaugacgucuucaccguuagcugccgugugcugacaagacccaguccggauuuugacuucaucuuucucguaccucccaccguggaauccaggacuaagccauucacagucccuauuuuaaccguggaggaaaugucuaacagccgguuucccaucccacuggagaaacuuuacacgggacccuccucagcguucguugugcagccucagaauggucgcuguacuaccgauggcgucuugcuggggacaacucaacuaagugccgugaacauaugcaccuucagaggagacguaacacauauugcaggcagccacgauuauaccaugaaucucgcuucucagaacuggaauaacuacgacccaacggaggaaaucccggcuccccuggguacuccugacuuuguugggaagauucagggaaugcuuacacagaccacuagggaggauggcuccacacgggcccauaaggccaccgugucaacgggcagcguccacuucaccccaaaacuggggagugugcaauacacaacugacaccaauaacgauuuucagacaggacagaauacuaaguucacccccgucggugugauccaagacggcaacaaucaccagaacgaaccucagcaguggguuuugccaaauuauucugggcgcacaggacauaacgugcaccucgcacccgccguagcuccgaccuuuccuggcgagcaacuguuauucuuucgauccacuaugccagguuguagcggguaccccaacaugaaucuggauugccuccuuccucaggaauggguccagcauuucuaucaggaggcggcacccgcccaaucggacguggcucuguugagauuuguuaacccagauacgggcagggugcuauucgaguguaaacugcacaagucuggauacgucacaguggcccacaccggcccucaugaccucguaauucccccaaauggguauuuucgguucgauuccugggugaaccaguuuuacacucuggcaccgaugggaaauggugccggccgucgcagauga

SEQ ID NO: 21479 - RNA, 1614 nt, Artificial Sequence
  derived and/or modified sequence opt3 from VP1__Norovirus_and/or_Norovirus-like__AY532122
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucaucgaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaagugaucuucgcugccguaccuccaaacuuuccgacggagggccucucccccucucagguuaccauguucccucauauuaucguggacguccgccaacuggagccagugcuuauaccccugccugaugugcgaaauaacuuuuaucacuacaaucagucgaacgacucaacaaucaaguugauugcaaugcucuauacuccacugcgugcuaacaaugccggggaugacgucuucaccguuagcugcagagugcugacaaggcccaguccggauuuugacuucaucuuucucguaccucccaccguggaaucccggacuaaaccauucacagucccuauuuuaaccguggaggaaaugucuaacagccgcuuucccaucccacuggagaaacuuuacacgggacccuccucagcguucguugugcagccucagaaugguagauguacuaccgauggcgucuugcuggggacaacucaacuaagugccgugaacauaugcaccuucggaggcgacguaacacauauugcagguagccacgauuauaccaugaaucucgcuucucagaacuggaauaacuacgacccaacggaggaaaucccggcuccccuggggacuccugacuuuguuggaaagauucagggcaugcuuacacagaccacuagggaggauggcuccacacgggcccauaaggccaccgugucaacggggagcguccacuucaccccaaagcugggaagugugcaauacacaacugacaccaauaacgauuuucagacaggucagaauacuaaauucacccccgucggcgugauccaagacggggauaaccaccagaaugaaccucagcaguggguuuugccaaacuauucuggacgcacaggccauaaugugcaccucgcacccgccguagcuccgaccuuuccuggugagcaacuguuauucuuucgauccacuaugccaggguguagcggcuaccccaacaugaaccuggacugccuccuuccucaggaauggguccagcauuucuaucaggaggcggcacccgcccaaucggauguggcucuguugagauuuguuaauccagacacgggaagggugcuauucgaguguaagcugcacaaaucuggcuacgucacaguggcccacaccgggccucaugaucucguaauucccccaaacggauauuuucgguucgacuccugggugaaucaguuuuacacucuggcaccgauggguaacggcgccgggcgucgcagauga

SEQ ID NO: 21480 - RNA, 1614 nt, Artificial Sequence
  derived and/or modified sequence opt3 from VP1__Norovirus_and/or_Norovirus-like__AY532120
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaauauuauagaccccuggaucagaaacaauuucguccaggcuccugguggcgaauuuacagugucaccaaggaacgcacccggggagauucuuuggagugccccucugggaccagauuugaaucccuacuuaagccaccuggcucggauguauaacggcuacgccgguggguucgaaguucaggugauccuagcgggaaaugcauuuacugccggcaaaauuaucuucgcugccgucccuccaaacuuuccgacggagggccucucccccucucaggugaccauguucccucauauaaucguagacguucgccaacuggagccagugcuuauuccccugccugauguccgaaauucguuuuaucacuacaaccagucaaaugacagcacaaucaaguugauugcaaugcucuauacuccacugcgugcuaacaacgccggggaugacguguucaccgugaguugcagaguccugacaaggcccuccccggauuuugacuucaucuuucucguuccucccaccguggaaucucggacuaaaccauucacaguaccuauauuaaccguggaggaaaugagcaauucccgcuuucccauuccacuggagaaacuuuacacgggacccucaagugcguucgucgugcagccucagaacgguagauguacuaccgauggcguuuugcuggggacaacucaacuaagcgccgugaauaucugcaccuucaggggagacgucacacauauugcaggcucucacgauuauaccaugaaccucgcuucccagaauuggaacaauuacgacccaacggaggaaaucccggcuccccuggguacuccugacuuuguggggaagauccagggaaugcuuacacagaccacucgggaggauggcucaacacgcgcccauaaggccaccguaagcacgggcaguguucacuucaccccaaagcuggggucugugcaauacacaacugacaccaacuccgauuuucagacaggacagaauacuaaauucacccccgucggugugauucaagacggcaacaaucaccagaacgaaccucagcagugggucuugccaaauuauagcgggggaacaggccauaacgugcaccucgcacccgccguugcuccgaccuuuccuggugagcaacuguuauucuuucgaucgacuaugccaggguguucuggcuaccccaauaugaaccuggauugcuauuccccucaggaaugggugcagcauuucuaccaggaggcggcacccgcccaaucagacguagcucuccuuagauuugucaacccagauacgggaagggugcuguucgaguguaaguugcacaaaaguggcuauguuacaguggcccacaccgggccucaugaccuagucauacccccaaauggauacuuucgguucgauagcugggugaaccaguuuuauacucuggcaccgauggguaauggcgccgggcgucgcagauga

SEQ ID NO: 21481 - RNA, 1614 nt, Artificial Sequence
  derived and/or modified sequence opt3 from VP1__Norovirus_and/or_Norovirus-like__AY532111
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugagcccagauuugaaucccuacuuaucccaccuggcucggauguauaacggauacgccggcgguuucgaagugcaggucauucuagcggggaaugcauuuacugccggaaaaaucauuuucgcugccgugccuccaaacuuuccgacggagggccucucucccucgcagguaaccauguucccucauaucauaguugacgugcgccaacuggagccaguccuuaucccccugccugaugugcgaaauaacuuuuaucacuacaaucagucaaacgacagcacaauuaaguugaucgcaaugcucuauacuccacugcgugcuaacaaugccggcgaugacguguucaccgucaguugcagaguucugacaaggcccuccccggauuuugacuucauuuuucucgugccucccaccguagaaucucggacuaaaccauucacagugccuaucuuaaccgucgaggaaaugagcaacucccgcuuucccauaccacuggagaaacuuuacacggggcccucaagugcguucgugguucagccucagaauggaagauguacuaccgaugguguguugcugggcacaacucaacuaagcgccgucaacauuugcaccuucaggggagacgugacacauaucgcagggucucacgauuauaccaugaaucucgcuucccagaacuggaauaacuacgacccaacggaggaaauuccggcuccccugggcacuccugacuuuguagguaagauccaggggaugcuuacacagaccacucgggaggauggaucaacacgcgcccauaaggccaccguuagcacgggcagugugcacuucaccccaaagcugggcucuguccaauacacaacugacaccaauaacgauuuucagacagggcagaauacuaaauucacccccgugggagucauccaagacgguaacaaucaccagaacgaaccucagcaguggguguugccaaauuauuccggccgaacagggcauaacguucaccucgcacccgccguggcuccgaccuuuccuggagagcaacuguuauucuuuagaagcacuaugccaggcuguucggguuaccccaacaugaaucuggauugccuccuuccucaggaauggguacagcauuucuaucaggaggcggcacccgcccaaucugacgucgcucuguugagguuugugaacccagauacggggcggguucuauucgaguguaagcugcacaaauccggcuacgugacagucgcccacaccggaccucaugaccucgugauucccccaaauggcuauuuucguuucgauucauggguaaaccagguguacacucuggcaccgauggggaauggagccggucgcagaagguga

SEQ ID NO: 21482 - RNA, 1614 nt, Artificial Sequence
  derived and/or modified sequence opt3 from VP1__Norovirus_and/or_Norovirus-like__AF080558
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucaucgaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacucaacaauuaaguugaucgcaaugcucuauacuccacugcgugcuaacaaugccggggaugacguguucaccgucagcugcagaguucugacaaggcccaguccggauuuugacuucauuuuucucgugccucccaccguagaaucccggacuaaaccauucacagugccuaucuuaaccgucgaggaaaugucuaacagccgcuuucccauaccacuggagaaacuuuacacgggacccuccucagcguucgugguucagccucagaaugguagauguacuaccgauggcguguugcuggggacaacucaacuaagugccgucaacauuugcaccuucaggggagacgugacacauaucgcaggcagccacgauuauaccaugaaucucgcuucucagaacuggaauaacuacgacccaacggaggaaauuccggcuccccuggguacuccugacuuuguagggaagauccagggaaugcuuacacagaccacucggggcgauggcuccacacgcgcccauaaggccaccguuucaacggggagcgugcacuucaccccaaagcugggaaguguccaauuuacaacugacaccaauaacgauuuccagacaggucagaauacuaaauuuacccccgugggcgucacacaagacggggauaaccaccagaaugagccucagcaguggguguugccaaacuacucuggacgaaccggccauaauguucaccucgcacccgccguggcuccgacuuucccuggugaacaacuguuauuuuucagauccacgaugccaggguguagcggcuaucccaacaugaaccuggacugccuccuuccucaggaguggguacagcauuuuuaccaggaagcggcacccgcccaaucggaugucgcucuguugagguucgugaauccagacacaggacggguucuauuugaguguaagcugcacaaaucuggcuaugugaccgucgcccacacugggccucaugaucucgugauucccccaaacggauacuuccguuuugacuccuggguaaaucaguucuauacccuggcaccgauggguaacggcgccgggcgcagaagguga

SEQ ID NO: 21483 - RNA, 1614 nt, Artificial Sequence
  derived and/or modified sequence opt3 from VP1__Norovirus_and/or_Norovirus-like__KF806508
augaagauggccagcaacgacgcuucccccucugauggcucagcagccaaucuggugccugaggucaguaacgaaguuauggcgcucgagccagugguaggggcugccaucgcagccccgguggcuggacagcaaaaugucauugaccccuggauaagaaacaauuucgugcaggcaccugguggcgaauuuaccguuagcccaaggaacgcccccggggagauccuuugguccgcuccucugggaccagauuugaaucccuacuuaucucaccuggcccggauguauaacggcuacgcggguggguucgaagugcaggucauucuagcaggaaaugccuuuacagcuggcaaaaucauuuucgccgcagugccuccaaacuuuccgacugagggccucucgcccucacagguaacgauguucccucauaucguuguggacguccgccaacuggagccagugcuuauaccccugccugaugugcgaaauaacuuuuaucacuacaaucagagcaaggacccaaccaucaaauugauugcuaugcucuauacaccccugcgugccaacaaugcgggggaagaugucuucacuguuaguugcagagugcugaccaggccguccccugacuuugauuucaucuuucucguacccccaacaguggagucucggagcaagccuuucaccguccccauuuuaacuguggaagagaugacaaacucccgcuuuccaaucccccuggagaaacuuuucaccggaccuucaggugccuucguugugcagccacagaacggcagauguacgacugacggggucuugcugggaaccacacaacuaaguccggugaauauaugcacuuuuaggggcgaucucacccauuucacagguaccagcgaauacgcaaugaaccuggcuucucagaauuggaacaauuaugaccccacggaggaaauuccugccccacuuggggcucccgauuuuguaggaaagauccggggcaugcugacucagacaacccgccgagacggcuccacuagagggcacagggccacauugucaaccggaagcgcacauuucacgccuaagcucgguaguauucgguuuucuaccgacacaaacaaugauuucgaggccggccagaacacuaaauuuaccccaguugggaucuuccaagaaggagacaaucaccagaacgagccccagcaaugggugcugccgaauuacuccggcgcuacagcgcacaacguccauuuagccccugcaguggcuccagccuuucccggugagcagcuccucuucuuucguagcacuaugccuggguguggcggauaccccaauaugaaccuugauugccuguugccacaggaauggguccagcacuucuaucaagaggcagccccugcucagucggacguggcccuacugcgcuuuguuaaucccgauaccucuagagugcuguucgaauguaagcugcauaaauccggcuacguaacagucgcacacaccgggcagcacgaccuugugaucccaccgaacggauauuucagguuugauucauggguuaaccaguucuacacucuggcgccuauggguaauggcacggggcggcgacgcuga

SEQ ID NO: 21484 - RNA, 1614 nt, Artificial Sequence
  derived and/or modified sequence opt3 from VP1__Norovirus_and/or_Norovirus-like__AF425766
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucauccaggcuccugguggcgaauuuacagugucaccaaggaacgcacccggggagauucuuuggagugccccucugggaccagauuugaaucccuacuuaagccaccuggcucggauguauaacggcuacgccgguggguucgaaguucaggugauccuagcgggaaaugcauuuacugccggcaaaauuaucuucgcugccgucccuccaaacuuuccgacggagggccucucccccucucaggugaccauguucccucauauaaucguagacguucgccaacuggagccagugcuuauuccccugccugauguccgaaauaacuuuuaucacuacaaucagucgaacgacucaacaaucaaguugauugcaaugcucuauacuccacugcgugcuaacaaugccggggaugacguguucaccgugagcugcagaguccugacaaggcccaguccggauuuugacuucaucuuucucguuccucccaccguggaaucccggacuaaaccauucacaguaccuauauuaaccguggaggaaaugucuaacagccgcuuucccauuccacuggagaaacuuuacacgggacccuccucagcguucgucgugcagccucagaaugguagauguacuaccgauggcguuuugcuggggacaacucaacuaagugccgugaacaucugcaccuucaggggagacgucacacauauugcaggcagccacgauuauaccaugaaucucgcuucucagaacuggaauaacuacgacccaacggaggaaaucccggcuccccuggguacuccugaccuuguggggaagauccagggaaugcugacacagaccacucgggaggauggcuccacacgcgcccauaaggccaccguaucaacgggcagcguucacuuuaccccaaaguuggggagugugcaauacacaacugacaccucuaaugauuuccagacaggacagaacacuaaauuuacccccgucggugugauucaagacggcaauaaccaccagaaugaaccucagcaguggguccucccaaacuauuccgggcgaacaggacauaaugugcaccuggcacccgccguugcuccgaccuucccuggcgagcaauuacuguuuuucagaagcacuaugccagguuguucgggguaccccaacaugaaccucgauugccuucugccucaggaaugggugcagcauuuuuaucaggaggcggcacccgcccaaucugacguagcuuugcuaagguucgucaauccagauacgggccgggugcuguuugaguguaagcuccacaaauccggauacguuacaguggcccacaccggcccucaugaccuggucauacccccaaacggguauuuccguuuugauucaugggugaaucaguucuacacucuugcaccgaugggaaacggugccggccgcagaagguga

SEQ ID NO: 21485 - RNA, 1614 nt, Artificial Sequence
  derived and/or modified sequence opt3 from VP1__Norovirus_and/or_Norovirus-like__AJ583672
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaacgaucuucgcugccgugccuccaaacuuuccgaccgagggccucucccccucucagguaacaauguucccucauauuaucguugacgugcgccaaccagagcccguccugauaccucuuccagaugugcgaaauaacuuuuaucacuacaaucagucgaacgaccccacuaucaagcugauugcaauguuguauaccccgcuccgugcuaacaaugccggggaugacguguucacagucucaugcagaguucugaccaggccuagccccgauuuugacuucaucuuucuggugccaccuacuguagaaagucggacaaaacccuucaccgugccaauucucacggucgaggaaaugacuaacucccgcuuucccaucccuuuagagaagcuguucaccggaccaucuaaugcguucgugguucagccgcagaacgguagauguacaacugauggcgugcuuuuggggaccacacaacugagccccgucaauauaugcaccuuuaggggagacgugacgcauauugccggcacucacgauuacacaaugaaccuagcaucccagaauuggaacaauuaugacccuaccgaggaaaucccagcuccccucgguacuccugacuucguagggaaaauucagggaguucugucacagacaacccggggcgauggcaguacgcgcgggcauaaggccaccgugagcacaggaucuguccacuuuacuccaaaacuugguuccgugcaauacaccacagacacuaacaaugaucuggaggcuggccagucaaccaaguucacacccgucggggugguucaggacggaaacaaucaccaaaacgaaccgcagcaguggguguugccuaauuacagcggccgaaccggucauaacguacaccucgucccagccguggcacccacuuuuccuggggagcagcuguuauucuuuagaaguacgaugcccggcuguucuggauauccaaacaugaaucuggauugccuccuuccucaagaauggguucagcauuucuaccaggaggccgcucccgcgcaguccgacguggcacuguugagguuugucaacccagauacaggccgggugcuauucgaguguaagcugcacaaaagcggguauguaaccguggcccacacuggaccgcaugaccucguuaucccucccaaugguuacuuucguuucgauucgugggucaaccaauuuuauacccuggcuccaaugggcaaugggacaggacgcagaagguga

SEQ ID NO: 21486 - RNA, 1614 nt, Artificial Sequence
  derived and/or modified sequence opt3 from VP1__Norovirus_and/or_Norovirus-like__AY532119
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucacagugccuaucuuaaccgucgaggaaaugagcaauucccgcuuucccauaccacuggagaaacuuuacacgggacccucaagugcguucgugguucagccucagaacgguagauguacuaccgauggcguguugcuggggacaacucaacuaagcgccgucaauauuugcaccuucaggggagacgugacacauaucgcaggcucucacgauuauaccaugaaccucgcuucccagaauuggaacaauuacgacccaacggaggaaauuccggcuccccuggguacuccugacuuuguagggaagauccagggaaugcuuacacagaccacucgggaggauggcucaacacgcgcccauaaggccaccguuagcacgggcagugugcacuucaccccaaagcuggggucuguccaauacacaacugacaccaacuccgauuuucagacaggacagaauacuaaauucacccccgugggugucauccaagacggcaacaaucaccagaacgaaccucagcaguggguguugccaaauuauagcgggcgaacaggacauaacguucaccucgcacccgccguggcuccgaccuuuccuggcgagcaacuguuauucuuuagaucgacuaugccagguuguucuggguaccccaauaugaaccuggauugccuccuuccucaggaauggguacagcauuucuaucaggaggcggcacccgcccaauccgacgucgcucuguugagguuugugaacccagauacgggccggguucuauucgaguguaagcugcacaaaucaggauacgugacagucgcccacaccggcccucaugaccucgugauucccccaaauggguauuuucguuucgauaguuggguaaaccaguuuuacacucuggcaccgaugggaaauggugccggccgcagaagguga

SEQ ID NO: 21487 - RNA, 1614 nt, Artificial Sequence
  derived and/or modified sequence opt3 from VP1__Norovirus_and/or_Norovirus-like__AF080552
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacucaacaauuaaguugaucgcaaugcucuauacuccacugcgugcuaacaaugccggggaugacguguucaccgucagcugcagaguucugacaaggcccaguccggauuuugacuucauuuuucucgugccucccaccguagaaucccggacuaaaccauucacagugccuaucuuaaccgucgaggaaaugucuaacagccgcuuucccauaccacuggagaaacuuuacacgggacccuccucagcguucgugguucagccucagaaugguagauguacuaccgauggcguguugcuggggacaacucaacuaagugccgucaacauuugcaccuucaggggagacgugacacauaucgcaggcagccacgauuauaccaugaaucucgcuucucagaacuggaauaacuacgacccaacggaggaaauuccggcuccccuggguacuccugacuuuguagggaagauccagggaaugcuuacacagaccacucgggaggauggcuccacacgcgcccauaaggccaccguuucaacgggcagcgugcacuucaccccaaagcuggggaguguccaauacacaacugacaccaauaacgauuuucagacaggacagaauacuaaauucacccccgugggugucauccaagacggcaacaaucaccagaacgaaccucagcaguggguguugccaaauuauucugggcgaacaggacauaacguucaccucgcacccgccguggcuccgaccuuuccuggcgagcaacuguuauucuuuagauccacuaugccagguuguagcggguaccccaacaugaaucuggauugccuccuuccucaggaauggguacagcauuucuaucaggaggcggcacccgcccaaucggacgucgcucuguugagguuugugaacccagauacgggccggguucuauucgaguguaagcugcacaaaucuggauacgugacagucgcccacaccggcccucaugaccucgugauucccccauccggguauuuucguuucgauucauggguaaaucaguuuuacacucuggcaccgaugggaaacggugccggccgcagaagguga

SEQ ID NO: 21488 - RNA, 1614 nt, Artificial Sequence
  derived and/or modified sequence opt3 from VP1__Norovirus_and/or_Norovirus-like__KX514177
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaacuuuuccgacggagggccucucccccucucagguaaccauguucccucauaucauaguugacgugcgccaacuggagccaguccuuaucccccugccugaugugcgaaacaauuuuuaucacuacaaccagucgaaugacucaacaauuaaguugaucgcuaugcucuauacuccacugcgugccaacaaccccggggaugacguguucaccgucagcugcagaguucugacaaggccgaguccugauuuugacuucauuuuucucgugcccccaaccguagaaucccggacuaaaccuuucucugugcccaucuuaacagucggagagaugaccaauagccgcuuuccagugaaccuggaaagacuuuucacgggucccuccucagcgaauguugugcagccucagaacgggagguguacuauagauggcgaguugcugggaaccacacaacuaaguagcgucaauauuugcacuuuccggggcgacgugacccauaucgguacaacccagcacuggacgaugaaccucgccucuccaaauuggaacaauuacgauccgacugaggaaacacccgcaccucuggggaccccagacuuuguaggaaagauucauggcaugcuuacucagacaacccaggagaacggcuccacgcgcgcucaccgagccaccguuuauguggggucagcuaauuucacacccaaacugggaaagguccaauuugaaacugacaccggugaugacuuggccaucagacagaacacaaaguucacuccugugggcgucauccagagcagugaucaccauagggacgagccacaacaguggcggcuccccaauuacucuggggcaaacaccuuuaaugugcaccuggccccggcuguugcgccuaacuucccaggagaacaguuacuguuuuuccguuccacacuccccggcuguggugggcauccuaacauggaucuugacugccuguugccccaggagugggugcaacacuuuuaccaggaggcagccccagcucagagcgauguagcccuacugcgcuucgucaauccugacaccucgagagugcucuuugaauguaaacugcacaagucuggcuauguuacuguggcacauacgggacaguacgaucuuguccugcccuccaacggcuauuucagguuugacucaugggugaaucaauucuacacauuggccccaauggggaacggaaccggucggcgacgcuga

SEQ ID NO: 21489 - RNA, 1614 nt, Artificial Sequence
  derived and/or modified sequence opt3 from VP1__Norovirus_and/or_Norovirus-like__KF806514
augaagauggccagcaacgacgcuucccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucguuguggacguccgccaacuggagccagugcuuauaccccugccugaugugcgaaacaauuuuuaucacuacaaccagucaaaggacccaaccaucaaauugauugcuaugcucuauacaccccugcgugccaauaacgcgggggaagaugucuucacuguuagcugcagagugcugaccaggccgaguccugacuuugauuucaucuuucucguacccccaacaguggagucccggucuaagccuuucaccguccccauuuuaacuguggaagagaugacaaacagccgcuuuccaaucccccuggagaaacuuuucaccggaccuuccggugccuucguugugcagccacagaauggcagauguacgacugacggggucuugcugggaaccacacaacuaucaccggugaacauaugcacuuuuaggggcgaucucacccauuucacagguaccagugaauacgcaaugaaucuggcuagccagaacugggacaauuaugaucccacggaggaaauuccugccccacuuggggcucccgacuuuguaggaaagauccggggcaugcugacucagacaacccgccgagacggcucuacuagagggcacagggccacauuguccaccggaucagcacauuucacgccuaagcucgguaacauucgguuuagcaccgauacaaauaacgacuucgaggccggccagaauacuaaauuuaccccaguugggguguuccaagaaggagauaaccaccagaaugagccccagcaauggguccugccgaacuacaguggcgcuacagcgcacaaugugcauuuagccccugcagucgcuccagccuuucccggugagcagcuccuguucuuucguucuacuaugccuggguguggcggauaccccaacaugaaucuugacugccuguugccacaggaaugggugcagcacuucuaucaagaggcagccccugcucaguccgauguugcccuacugcgcuuugugaaccccgacaccagcagaguacucuucgaauguaagcugcauaaaucgggcuacgucacaguggcacacaccgggcagcacgaucuuguuaucccaccgaacggauauuucagguuugacucuugggugaaucaguucuacacucuggcgccuauggguaacggcacggggcggcgacgcuga

SEQ ID NO: 21490 - RNA, 1614 nt, Artificial Sequence
  derived and/or modified sequence opt3 from VP1__Norovirus_and/or_Norovirus-like__AB303925
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacucaacaauuaaguugaucgcaaugcucuauacuccacugcgugcuaacaaugccggggaugacguguucaccgucagcugcagaguucugacaaggcccaguccggauuuugacuucauuuuucucgugccucccaccguagaaucccggacuaaaccauucacagugccuaucuuaaccgucgaggaaaugucuaacagccgcuuucccauaccacuggagaaacuuuucacgggacccuccucagcguucgugguucagccucagaaugguagauguacuaccgauggcguguugcuggggacaacucaacuaagugccgucaacauuugcaccuuuaggggagacgugacacauaucgcaggcagccacgauuacaccaugaaucucgcuucucagaacuggaauaacuaugacccaacggaggaaauuccggcuccccuggguacuccugacuucguagggaagauccagggaaugcuuacacagaccacucgggaggauggcuccacacgcgcccauaaggccaccguuucaacgggcagcgugcacuuuaccccaaagcuggggaguguccaauacacaacugacaccaauaacgauuuccagacaggacagaauacuaaauuuacccccgugggugucauccaagacggcaacaaucaccagaacgaaccucagcaguggguguugccaaauuacucugggcgaacaggacauaacguucaccucgcacccgccguggcuccgaccuucccuggcgagcaacuguuauuuuucagauccacuaugccagguuguagcggguaucccaacauggaucuggacugccuccuuccucaggaauggguacagcauuuuuaccaggaggcggcacccgcccaaucggaugucgcucuguugagguucgugaauccagacacgggccggguucuauuugaguguaagcugcacaaaucuggauaugugacagucgcccacaccggcccucaugaucucgugauucccccaaacggguacuuccguuuugacuccuggauaaaucaguucuauacucuggcaccgaugggaaacggugccggccgcagaagguga

SEQ ID NO: 21491 - RNA, 1614 nt, Artificial Sequence
  derived and/or modified sequence opt3 from VP1__Norovirus_and/or_Norovirus-like__KF806534
augaagauggccagcaacgacgcuucccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucguuguggacguccgccaacuggagccagugcuuauaccccugccugaugugcgaaacaauuuuuaucacuacaaccagucaaaggacccaaccaucaaauugauugcuaugcucuauacaccccugcgugccaauaacgcgggggaagaugucuucacuguuagcugcagagugcugaccaggccgaguccugacuuugauuucaucuuucucguacccccaacaguggagucccggucuaagccuuucaccguccccauuuuaacuguggaagagaugacaaacagccgcuuuccaaucccccuggagaaacuuuucaccggaccuuccucagccuucguugugcagccacagaaugguagauguacgacugacggcgucuugcuggggaccacacaacuaaguccggugaacauaugcacuuuuaggggagaucucacccauuucgcaggcacaagcgaauacgcuaugaaucuggccucucagaacuggaccaauuaugaccccacggaggaaauuccugcuccacuuggugcccccgauuuuguagggaagauccggggaguucugacucagacaacccgccgagacggcuccacuagaggccacagggcaacauugucaaccgggagcgcccauuucacgccuaagcucggaaguauucgguuuucuaccgacacaaacaaugauuucgaggcuggucagaacacuaaauuuaccccagugggcgucuuccaagacggggauaaucaccagaacgaaccccagcaaugggugcugccgaauuacuccggagcgacagcacacaacguccauuuagccccugcuguggccccagcauuucccggcgagcagcuccuguucuuucguagcacuaugccugguuguucgggguaccccaauaugaaccuugacugccuguugccacaggaguggguucagcacuucuaucaagaagccgcuccugcccagucugauguggcacuacugcgcuuuguaaaucccgacaccuccagaguccucuucgaguguaagcugcauaaaucaggcuacgugacaguugcgcacaccggacagcacgaucuugugaucccaccgaacggcuauuucagguuugacaguugggucaaccaguucuacacucuggcuccuauggggaauggaacgggucggcgacgcuga

SEQ ID NO: 21492 - RNA, 1614 nt, Artificial Sequence
  derived and/or modified sequence opt3 from VP1__Norovirus_and/or_Norovirus-like__KF806519
augaagauggccagcaacgacgcuucccccucugauggcucagcagccaaucuggugccugaggucaacaaugaaguuauggcgcucgagccagugguaggggcuaccaucgccgcaccgguggccggacagcaaaacgucaucgaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucguuguggacguccgccaacuggagccagugcuuauaccccugccugaugugcgaaacaauuuuuaucacuacaaccagucaaaggacccaacaaucaaauugauugcaaugcucuauacuccccugcgugcuaauaacgccggggaagaugucuucaccguuagcugcagagugcugacaaggccgaguccugacuuugauuucaucuuucucguaucccccaccguggagucucggagcaagccauucacugucccuauuuuaacaguggaagagaugaccaacucccgcuuucccaucccacuggagaaacuuuucacgggacccucaggugcguucguugugcagccucagaauggcagauguacuaccgacggggucuugcugggaacaacucaacuaaguccagugaacauaugcaccuuuaggggcgaucucacacauuucaccgguacgagcgaauacgccaugaaucuggcaucucagaacuggaauaacuaugacccgacugaggaaauucccgcuccucuuggggccccagauuuuguaggaaagauccggggcaugcugacacagaccacucgccgagacggcuccacaagagggcacagggcuaccuugucaacgggaagcgcccauuucacccccaagcucgguaauauucgguuuaguacagacacuaacaaugauuucgaggcaggccagaacaccaaauuuacaccuguugggguguuccaagaaggagacaaucaccagaacgagccacagcaauggguccugcccaauuacucuggcgccacugcucacaacgugcauuuagcgccggcagucgccccugcuuuuccaggugagcagcuccuguucuuucguuccaccaugcccggguguggcggauacccuaauaugaaccuugauugccuguugccccaggaaugggugcagcacuucuaucaagaggccgcaccagcccagagcgacguugcucuacugcgcuuugugaacccugauacaucgagaguacucuucgaauguaagcugcauaaaucuggcuacgucaccguggcccacacugggcagcacgaccuuguuauucccccaaauggauauuucagguuugauuccugggugaaccaguucuacacgcuggcaccgauggguaauggcacagggcggcgacgcuga

SEQ ID NO: 21493 - RNA, 1614 nt, Artificial Sequence
  derived and/or modified sequence opt3 from VP1__Norovirus_and/or_Norovirus-like__AB303924
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacucaacaauuaaguugaucgcaaugcucuauacuccacugcgugcuaacaaugccggggaugacguguucaccgucuuuugcagaguucugacaaggcccagcccggauuucgacuuuauuuuccucgugccucccaccguagaaagucggacuaaaccauuuacagugccuaucuuaaccgucgaggaaauguccaacucucgcuuccccauaccacuggagaaacuuuacacgggacccagcuccgcguucgugguucagccucagaaugguagauguacuaccgauggcguguugcuggggacaacucaacuaucagccgucaacauuugcaccuuuaggggagacgugacacauaucgcaggcagucacgauuauaccaugaaucucgcuagccagaacuggaauaacuacgacccaacggaggaaauuccggcuccccuggguacuccugacuucguagggaagauccagggaaugcuuacacagaccacucgggaggauggcucuacacgcgcccauaaggccaccguuuccacgggcucagugcacuuuaccccaaagcuggggagcguccaauacacaacugacaccaauaacgauuuccagacaggacagaauacuaaauuuacccccgugggugucauccaagacggcaacaaucaccagaacgaaccucagcaguggguguugccaaauuauagugggcgaacaggacauaacguucaccucgcacccgccguggcuccgaccuucccuggcgagcaacuguuauuuuucagaucuacuaugccagguuguuccggguaccccaacaugaaucuggauugccuccuuccucaggaauggguacagcauuuuuaucaggaggcggcacccgcccaaagcgacgucgcucuguugagguucgugaacccagauacgggccggguucuauuugaguguaagcugcacaaaucgggauacgugacagucgcccacaccggcccucaugaccucgugauucccccaaauggguauuuccguuuugauucuuggguaaaccaguucuacacucuggcaccgaugggaaauggugccggccgcagaagguga

SEQ ID NO: 21494 - RNA, 1614 nt, Artificial Sequence
  derived and/or modified sequence opt3 from VP1__Norovirus_and/or_Norovirus-like__DQ975270
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggacuuauaacggcuacgccgguggguucgaagugcaggucauucuagcgggaaaugcauuuacggccggcaaaaucauuuucgcugccgugccuccaaacuuuccgaccgagggccucucccccucucagguaacaauguucccucauaucauaguugacgugcgccaacuggagccaguccuuaucccccugccugaugugcgaaauaacuuuuaucacuacaaucagucgaacgacucaacuauuaaguugaucgcaaugcucuauaccccacugcgugcuaacaaugccggggaugacguguucacagucagcugcagaguucugaccaggcccaguccggauuuugacuucauuuuucucgugccucccacuguagaaucccggacaaaaccauucaccgugccuaucuuaacggucgaggaaaugucuaacagccgcuuucccauaccacuggagaaacuuuacacuggacccuccucagcguucgugguucagccucagaaugguagauguaccacagauggcguguugcuggggacuacccaacuaagugccgucaacauuugcacauucaggggagacgugacccauaucgcaggcagccacgauuauacgaugaaucucgcuucucagaacuggaauaacuacgacccaacugaggaaauuccggcuccccuggguacaccugacuuuguagggaagauccagggaaugcuuacccagacuacacgggaggauggcuccacccgcgcccauaaggccacgguuucaaccggcagcgugcacuucacaccaaagcuggggaguguccaauacacuaccgacacaaauaacgauuuucagacuggacagaauaccaaauucacacccgugggugucauccaagacggcaacaaucaccagaacgaaccucagcaguggguguugccaaauuauucugggcgaaccggacauaacguucaccucgcacccgccguggcuccgacuuuuccuggcgagcaacuguuauucuuuagauccacgaugccagguuguagcggguaccccaacaugaaucuggauugccuccuuccucaggaauggguacagcauuucuaucaggaggcggcacccgcccaaucggacgucgcucuguugagguuugugaacccagauacaggccggguucuauucgaguguaagcugcacaaaucuggauacgugaccgucgcccacacuggcccucaugaccucgugauucccccaaauggguauuuucguuucgauuccuggguaaaccaguuuuacacccuggcaccgaugggaaauggugccggccgcagaagguga

SEQ ID NO: 21495 - RNA, 1614 nt, Artificial Sequence
  derived and/or modified sequence opt3 from VP1__Norovirus_and/or_Norovirus-like__AF414424
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacguggggcaacuggagccaguccuuaucccccugccugaugugcgcaauaacuuuuaucacuacaaucagucgaacgacucaacaauuaaguugaucgcaaugcucuauacuccacugcgagcuaacaaugccggagaugacguguucaccgucagcugccguguucugacaagacccaguccggauuuugacuucauuuuucucgugccucccaccguagaauccaggacuaaaccauucacagugccuaucuuaaccgucgaggaaaugucuaacagccgguuucccauaccacuggagaaacuuuacacgggucccuccucagcguucgugguucagccucagaauggccgcuguacuaccgaugggguguugcugggaacaacucaacuaagugccgucaacauuugcaccuucagaggcgacgugacacauaucgcagguagccacgauuauaccaugaaucucgcuucucagaacuggaauaacuacgacccaacggaggaaauuccggcuccccuggggacuccugacuuuguaggaaagauccagggcguucuuacacagaccacuagggaggauggcuccacacgggcccauaaggccaccgugucaacggggagcguccacuucaccccaaagcugggaagugugcaauacacaacugacaccaauaacgauuuucagacaggucagaauacuaaauucacccccgucggcgugauccaagacgggaacaaucaccagaacgaaccucagcaguggguuuugccaaauuauucuggacgcacaggccauaacgugcaccucgcacccgccguagcuccgaccuuuccuggugagcaacuguuauucuuucgauccacuaugccaggguguagcggcuaccccaacaugaaucuggauugccuccuuccucaggaauggguccagcauuucuaucaggaggcggcacccgcccaaucggacguggcucuguugagauuuguuaacccagauacgggaagggugcuauucgaguguaagcugcacaaaucuggcuacgucacaguggcccacaccgggccucaugaccucguaacucccccaaauggauauuuucgguucgauuccugggugaaccaguuuuacacccuggcaccgauggguaauggcgccgggcgucgcagauga

SEQ ID NO: 21496 - RNA, 1614 nt, Artificial Sequence
  derived and/or modified sequence opt3 from VP1__Norovirus_and/or_Norovirus-like__LC048964
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucaucgaccccuggauaagaucaaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucacagugccuaucuuaaccgucgaggaaaugagcaauucccgcuuucccauaccacuggagaaacuuuacacgggacccucaagugcguucgugguucagccucagaacgguagauguacuaccgauggcguguugcuggggacaacucaacuaagcgccgucaauauuugcaccuucaggggagacgugacacauaucgcaggcucucacgauuauaccaugaaccucgcuucccagaauuggaacaauuacgacccaacggaggaaauuccggcuccccuggguacuccugacuuuguagggaagaaccagggacuucugucacagacaacccggggcgauggcagcacucgcgcccauaaggccacaguuaguaccgggucugugcacuucacgccaaaguugggauccguccaauacaccacagacacuaauaacgauuuugagaccggucagaauacaaaauucacucccgugggcgucauccaggacgggaacaaucaccaaaacgaaccucagcagugggcacucccaaauuauagcggacgaaccggccauaacgugcaccuggcccccgcuguugcgccgacauuuccuggugagcaguuacuguucuuuagaucgaccaugccaggguguucuggcuaccccaacaugaaucucgauugccuucugccucaagaaugggugcagcauuucuaucaggaggcagcccccgcucaguccgacguagccuugcuaagguuugucaacccagauacuggacgggugcuguucgaguguaagcuccacaaaucaggcuacguuacgguggcacacacagggccucaugaccuggucauucccccaaauggauauuuucguuucgauaguugggugaaccaauuuuacacccuugccccgauggguaauggcgcugggcgcagaagguga

SEQ ID NO: 21497 - RNA, 1614 nt, Artificial Sequence
  derived and/or modified sequence opt3 from VP1__Norovirus_and/or_Norovirus-like__AB684705
augaagauggccagcuccgacgcuaaccccucugauggcucagcagccaaucuggugccugaggucaacaaugaaguuauggcgcucgagccagugguaggggcugccaucgcagccccgguggcuggacagcaaaacauuauagaccccuggaucagaaauaacuucguccaggcaccugguggcgaauuuaccgugaguccaaggaaugcccccggggagauucuuuggagcgcuccucuguccccagauuugaaccccuacuuaucucaccugucgcggauguauaauggauacgccggcgguuucgaaguucaggugauccuagcggggaacgcauuuacagccggaaaagucauuuucgcugccgugccuccaaauuuuccgacugagggccucucacccagccagguaacgauguucccucauaucauaguugacgugcgccaacuggagccaguccuuaucccccugccugaugugcgaaacaauuuuuaucacuacaaccagacccaugacaguacauugaagcucauugcaaugcuguauacuccacugcgugcuaauaacgccggcgaugacguguucaccgucuccugcagaguucucacaaggcccucuccggauuuugacuucaucuuuuuagugccucccaccguagaaagccggacuaaaccauucacagugccuauucugaccgucgaggaaauguccaacucacgcuuucccaucccacuugagaaguuguacacggggcccaguagcgcguucgugguucagccucagaauggaagauguacuaccgauggugugcugcuaggcacaacucaacucucugccgucaacauaugcaauuucaggggagacgugacccggguagggauuucccacgauuauacaaugaaccugguuucacagaauuggaacaauuacgacccaaccgaggaaaucccggcaccccuuggcacgccugacuuuguggguaaaauucaggggcuguugacucagacaacccgcgcugauagcaguacucgagcccauaaggcuacacucucuaccggauccguccacuucacgccaaagcugggcagcgugcaauuuaccacagacacuaacaaugauuuccagaccggccagaacacaaaauuuacucccgucggggugauccaagacucggaucaccaucagaaugagccucagcaguggguuuuaccaaacuacucuggauccucaggucacaaugugcaucuggcccccgcaguagccccgaccuucccuggcgaacaacuccuguuuuucagaaguacaaugccaggguguagcggauaucccaacaugaaucuugacugcuugcuaccucaggaguggguccugcacuuuuaccaggaagcugcgcccgcacaguccgauguggcccuccugagguucguuaacccagacaccggccgggugcuuuuugaguguaagcugcacaaaucugguuauaucacugucgcucauacggggccuuacgauuuggugauucccccaaacggcuauuuccguuuugacagcuggguaaaucaauucuacacacucgccccgaugggaaacggcaccgggcgcagaagguga

SEQ ID NO: 21498 - RNA, 1614 nt, Artificial Sequence
  derived and/or modified sequence opt3 from VP1__Norovirus_and/or_Norovirus-like__KF806523
augaagauggccagcaacgacgcuucccccucugauggcucagcagccaaucuggugccugaggucaacaaugaaguuauggcgcucgagccagugguaggggcugccaucgcagccccgguggcuggacagcaaaacgucaucgaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucguuguggacguccgccaacuggagccagugcuuauaccccugccugaugugcgaaacaauuuuuaucacuacaaccagucaaaggacccaaccaucaaauugauugcuaugcucuauacaccccugcgugccaauaacgcgggggaagaugucuucacuguuagcugcagagugcugaccaggccgaguccugacuuugauuucaucuuucucguaucccccacaguggagucucggagcaagccauucaccgucccuauuuuaacuguggaagagaugacaaacucccgcuuucccaucccacuggagaaacuuuucaccggacccucaggugccuucguugugcagccucagaauggcagauguacgacugacggggucuugcugggaaccacacaacuaaguccagugaacauaugcacuuuuaggggcgaucucacccauuucacagguaccagcgaauacgcaaugaaucuggcuucucagaacuggaauaacuaugacccgacggaggaaauucccgccccucuuggggcuccagauuuuguaggaaagauccggggcaugcugacucagacaacccgccgagacggcuccacuagagggcacagggccacauugucaaccggaagcgcacauuucacgcccaagcucgguaauauucgguuuaguaccgacacaaacaaugauuucgaggccggccagaacacuaaauuuaccccuguugggguguuccaagaaggagacaaucaccagaacgagccacagcaauggguccugcccaauuacucuggcgcuacagcgcacaacgugcauuuagcaccggccgucgcuccugccuuuccaggugagcagcuccuguucuuucguuccacuaugcccggguguggcggauacccuaauaugaaccuugauugccuguugccccaggaaugggugcagcacuucuaucaagaggcagccccagcucagagcgacguugcccuacugcgcuuugugaacccugauaccucgagaguacucuucgaauguaagcugcauaaaucuggcuacgucacaguggcacacaccgggcagcacgaccuuguuauucccccaaauggauauuucagguuugauuccugggugaaccaguucuacacucuggcgccgauggguaauggcacggggcggcgacgcuga

SEQ ID NO: 21499 - RNA, 1614 nt, Artificial Sequence
  derived and/or modified sequence opt3 from VP1__Norovirus_and/or_Norovirus-like__AY532129
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcucacgguggcgaauuuacaguuucaccuaggaacgcaccaggggagauccuuuggagugcaccccugggaccugauuugaauccauacuuaagccaucuggcucggauguauaacggcuacgccgguggguucgaagugcaggucauucuagcgggaaaugcauuuacugccggcaaaaucauuuucgcugccgugcccccuaacuuuccaacggagggccucuccccgucucagguaaccauguucccccacaucauaguugacgugcgccaacuggagccuguccuuaucccacugcccgaugugcgaaauaacuuuuaucauuacaaucagucgaacgacucaacaauuaaguugaucgcaaugcucuauacuccucugcgugcuaacaaugccggggaugacguguucaccgucagcugcagaguucugacaaggccaagucccgauuuugacuucauuuuucucgugccgccuaccguagaaucccggacuaaacccuucacagugccaaucuuaaccgucgaggaaaugucuaacagccgcuuuccuauaccccuggagaaacuuuacacgggaccauccucagcguucgugguucagccccagaaugguagauguacuaccgauggcguguugcuggggacaacucaacuaagugccgucaacauuugcaccuucaggggagacgugacacacaucgcaggcagccaugauuauaccaugaaucucgcuucucagaacuggaacuccuacgacccuacggaggaaauuccagccccgcuggguacucccgacuuuguagggaagauccagggaaugcuuacacagaccacucgggaggauggcucaacacgcgcucacaaggccaccguuagcacgggcagugugcacuucaccccuaagcuggggucuguccaauacacaacugacaccaauaaugauuuucagacaggacagaacacuaaauucaccccagugggugucauccaagacggcaauaaccaucagaaugaaccccagcaguggguguugccuaacuauuccgggcgaacaggacacaauguucaucucgcaccagccguggcucccaccuuuccgggcgagcaacuguuauucuuuagaagcacuaugccugguuguucgggguacccaaacaugaaccuggauugccuccuuccccaggaauggguacagcacuucuaucaggaggcggccccugcccaaucugacgucgcucuguugagguuugugaaucccgauacgggccggguucuauucgaguguaagcugcacaaauccggauacgugacagucgcccauaccggcccacacgaccucgugauuccucccaacggguauuuucguuucgauucauggguaaaucaguuuuacacucuggcaccaaugggaaacggugccggccgcagaagguga

SEQ ID NO: 21500 - RNA, 1614 nt, Artificial Sequence
  derived and/or modified sequence opt3 from VP1__Norovirus_and/or_Norovirus-like__AY532124
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucaucgaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgcgcaaugcauuuacugccggaaaagugaucuucgcugccguaccuccaaacuuuccgacggagggccucucccccucucagguuaccauguucccucauauuaucguggacguccgacaacuggagccagugcuuauaccccugccugaugugcguaauaacuuuuaucacuacaaucagucgaacgacucaacaaucaaguugauugcaaugcucuauacuccacugagagcuaacaaugccggcgaugacgucuucaccguuagcugcagggugcugacacggcccaguccggauuuugacuucaucuuucucguaccucccaccguggaaucccgcacuaaaccauucacagucccuauuuuaaccguggaggaaaugucuaacagcagauuucccaucccacuggagaaacuuuacacggggcccuccucagcguucguugugcagccucagaauggaagguguacuaccgauggugucuugcugggcacaacucaacuaagugccgugaacauaugcaccuuccgcggggacguaacacauauugcaggaagccacgauuauaccaugaaucucgcuucucagaacuggaauaacuacgacccaacggaggaaaucccggcuccccugggcacuccugacuuuguugguaagauucaggggaugcuuacacagaccacucgggaggauggauccacacgagcccauaaggccaccgugucaacgggcagcguccacuucaccccaaagcugggcagugugcaauacacaacugacaccaauaacgauuuucagacagggcagaauacuaaauucacccccgucggagugauccaagacgguaacaaucaccagaacgaaccucagcaguggguuuugccaaauuauucuggcagaacagggcauaacgugcaccucgcacccgccguagcuccgaccuuuccuggagagcaacuguuauucuuuagguccacuaugccaggcuguagcgguuaccccaacaugaaucuggauugccuccuuccucaggaauggguccagcauuucuaucaggaggcggcacccgcccaaucggacguggcucuguugcgguuuguuaacccagauacggggcgugugcuauucgaguguaagcugcacaaaucuggcuacgucacaguggcccacaccggaccucaugaccucguaauucccccaaauggcuauuuucgcuucgauuccugggugaaccaguuuuacacucuggcaccgauggggaauggagccgguagaaggcgguga

SEQ ID NO: 21501 - RNA, 1614 nt, Artificial Sequence
  derived and/or modified sequence opt3 from VP1__Norovirus_and/or_Norovirus-like__KX514309
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaucccggggaugacguguucacugucagcugcagaguucugaccaggccgaguccugauuuugacuucauuuuucucgugcccccaacaguagaaucccggaccaaaccuuucucugugcccaucuuaacugucggagagaugacaaacagccgcuuuccaauaaaucuggaaagacuuuucaccggucccuccucagcgaacgugguucagccucagaaugggagguguacgauugauggcgaguugcugggaacuacccaacuaaguagcgugaacaucugcacauuccggggcgacgucacucauccaggugggucuaagauuuacaccaugaaucucgccuccccgaacuggaauaacuaugaucccacagaggaaaucccugcaccacugggaacccccgacuuugugggcaaaauccacggcaugcuuacgcagacuacaaagggggagggaucaacccgcggucaucgagcuacuguauacguuggcggggccaauuucacaccuaagcugggaaaagugcaguuugaaaccgacacgggcgaugacuuggcuauuagacagaacaccaaguucacaccagucggugugauacaaagcagugaucaccacagggacgagccccagcaguggcggcucccgaauuacucuggggccaacacuuuuaauguccaucuggccccugcaguggcuccaaacuuccccggcgaacaauuacuguuuuuccguuccacccucccuggauguggcgggcaccccaacauggaucuugacugccuguugccacaggaguggguucagcauuuuuaucaggaggcggccccugcacaaagcgauguggcucuacugcgcuucguaaaucccgacacaucgagaguccucuuugaauguaaacugcacaagucuggauacgugacuguugcccacaccggucagcaugaucuugugaucccaccgaacggcuauuucagguuugacuccugggucaaucaguucuacacacuggcaccuauggggaacggaaccggccggaaacgauga

SEQ ID NO: 21502 - RNA, 1614 nt, Artificial Sequence
  derived and/or modified sequence opt3 from VP1__Norovirus_and/or_Norovirus-like__KX514308
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaaccccggggaugacguguucaccgucaguugcagaguucugacaaggccguccccugauuuugacuucauuuuucucgugcccccaaccguagaaucucggacuaaaccuuucagcgugcccaucuuaacagucggagagaugaccaauucccgcuuuccaauaaaccuggauaaacuuuucacgggucccucaagugccaaugugguucagccucagaacggcagauguacuauugacggggaauugcugggaaccacacaacuaagcucugugaauaucugcacuuucaggggcgaugucacccauauugguuccacacggcacuggaccaugaaccucgcgucaccaaauuggaacaauuacgacccgacggaggagacucccgccccucuggggacaccagacuuugugggaaagauccauggcaugcuuacccagacuacacaggaaaacggcagcacccgcgcacaccgagcuacgguauauguugggagugccgauuucacccccaagcugggaaaggugcaguuugagacagacacugaagaugacuuggcuaucagacaaaauaccaaauucacaccugucggugugauucagucuuccgaucaccauagggacgagccacagcaauggcggcuccccaacuacagcggcgccaauacuuuuaacguccaccuggcaccggccguggcuccuaauuucccaggggaacaguuacuguuuuuccguucgacccuccccggauguggcggucauccuaacauggaucuugacugccuguugccccaggaguggguucagcacuuuuaccaagaggcggcaccagcccagucugauguggcucuacugcgcuucguaaacccugacacauccagaguccucuuugaauguaagcugcacaaaucaggguaugugaccguugcccauacuggccaguacgaucuugugcugcccaguaauggauauuucagguuugacagcugggucaaccaguucuacacguuggcaccaaugggcaaugggacaggacggcgacgcuga

SEQ ID NO: 21503 - RNA, 1614 nt, Artificial Sequence
  derived and/or modified sequence opt3 from VP1__Norovirus_and/or_Norovirus-like__KX514283
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaaggacucaaccauuaaauugaucgcuaugcucuauacaccacugcgugccaacaacgcgggggaugacguguucacugucagcugcagaguucugaccaggcccaguccggauuuugacuucauuuuucucgugccucccacaguagaaucccggucuaagccauucagcgugccugucuuaaccguggaggaaaugacuaauucccgcuuucccguuacacuggauaaacuuuucaccggaccaucaaguacgaucgugguccagccccagaacgguagauguaugauagacggcguguugcuggggacuacccaacuaagcccuguaaauauuugcacauucaggggagauguuacucauccacgggacucuaccaucuacacaaugaaccucgccuccccgaauuggaacaauuaugaccccaccgaggagauuccugcaccacugggcacgcccgauuuuacugguaagauccaggggaugcuuacacagaccacuaagggagaaggcucaacacgcggccaccgagcuaccguguacgucgggagcgccgaguucacgccuaaacugggaaaggugagauuugaaaccgacacagaggaugacuuggucaucaggcagaacacuaaauucaccccaguggguguuauucaaaguucugaucaucaccgggacgaaccccagcaguggcgucucccgaauuacuccggcgcuaacacauuuaaugugcaccuggccccugcaguagccccaaacuuccccggggagcaauuacuguuuuuccgcagcacucucccuggauguggcggucaucccaauauggaucuugacugccuguugccacaggaguggguccagcacuuuuaucaggaagcugcgccugcacaaucggauguggcccuacugagauucguuaaccccgacaccucuagggugcucuuugaguguaagcugcauaaauccggguacgucacaguggcucacaccggccaguaugaucuuguacugccaucaaauggauacuuccgguuugacaguugggugaaccaguucuauacuuuggccccgaugggcaacgggacgggacgacgcagauga

SEQ ID NO: 21504 - RNA, 1614 nt, Artificial Sequence
  derived and/or modified sequence opt3 from VP1__Norovirus_and/or_Norovirus-like__KX514194
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaacuuuuccgacggagggccucucucccucgcagguaaccauguucccucauaucauaguugacgugcgccaacuggagccaguccuuaucccccugccugaugugcgaaauaacuuuuaucacuacaaucagucaaacgacagcacaauuaaguugaucgcuaugcucuauacuccacugcgugccaauaaccccggggaugacguguucaccgucaguugcagaguucugacaaggccguccccugauuuugacuucauuuuucucgugcccccaaccguagaaucucggacuaaaccuuucagcgugcccaucuuaacagucggagagaugaccaacucccgcuuuccaauaaaucuggaaagacuuuucacgggucccucaagugcgaacgugguucagccucagaaugggagguguacuauugauggcgaguugcugggaaccacacaacuaagcucugugaacaucugcacuuuccggggcgacgucacccauauugguuccacacaccauuggaccaugaaucucgccucaccaaacuggaauaacuacgauccgacggaggaaacucccgcaccucuggggacaccagacuuugugggaaagauccacggcaugcuuacccagacuacacagggcaaugggagcacccgcggacaccgagcuacgguauauguugguagugccgaguucacccccaaacugggcaaggugcaguuuaagacagaaacugaccaugauuuggcuaucagacaaaacaccaaauucacaccugucggggugauucaggagucugaccaccauagggaugaaccacagcaauggcggcuccccaauuacuccggagccaacacuuuuaauguccaccuggcaccggccguggcuccuaacuucccaggcgagcaguuacuguuuuuccguagcacccuccccgguugugggggccacccuaauauggaccuugauugccuguugccccaggaguggguucagcauuuuuaccaagaagcggcaccagcccagucggacguggcucuacugcgcuucguaaacccugauacaucuagaguccucuuugaguguaagcugcacaaauccggauaugugaccguugcccauacuggccaguacgaccuugugcugcccucaaacggguauuucagguuugauaguugggucaaucaguucuacacguuggcaccaaugggaaacgguacaggccggcgacgcuga

SEQ ID NO: 21505 - RNA, 1614 nt, Artificial Sequence
  derived and/or modified sequence opt3 from VP1__Norovirus_and/or_Norovirus-like__KY424340
augaagauggccagcuccgacgcuaaccccucugauggcucagcagccaaucuggugccugaggucaacaaugaaguuauggcgcucgagccagugguaggggcugccaucgcagccccgguggcuggacagcaaaacauuauagaccccuggaucagaaauaacuucguccaggcaccugguggcgaauuuaccgugaguccaaggaaugcccccggggagauucuuuggagcgcuccucugggaccagauuugaaccccuacuuaucccaccugucucggauguauaauggcuacgccgguggguucgaaguucaggugauccuagcgggaaacgcauuuacagccggcaaagucauuuucgcugccgugccuccaaauuuuccgacugagggccucucgcccucacagguaacgauguucccucauaucauaguugacgugcgccaacuggagccaguccuuaucccccugccugaugugcgaaacaauuuuuaucacuacaaccagagccaugacaguaccuugaagcucauugcaaugcuguauacaccacugcgugcuaauaacgccggggaugacguguucacugucuccugcagaguucucaccaggcccucuccggauuuugacuucaucuuuuuagugccucccacaguagaaagccggaccaaaccauucacugugccuauucugacagucgaggaaauguccaacucacgcuuucccaucccacuugagaaguuguacaccggacccaguagcgcguucgugguucagccucagaaugguagauguacgacugauggcgugcugcuagggaccacacaacucucugccgucaacauaugcaauuucaggggagacgugacucacauuguaggcucccaugauuauaccaugaaccuggcaucacagaauuggagcaacuacgacccaacagaggaaaucccggcuccccuugguaccccugacuuuguugggaaaauucagggacuguugacgcagacuacacgggccgauggcaguacccgcgcucacaaggccacugugucuacaggcuccguccacuucaccccaaagcucgggagcgugcaauuuacgaccgacacaaauaacgauuuccagacuggacagaauaccaaauuuacacccgucggugugauccaagacggcgaucaucaccagaacgagccucagcaguggguucugccaaauuacucggggcgaacuggacauaacgugcacuuagcacccgccguagcuccgaccuucccuggcgaacaacugcucuuuuucagaucuacaaugccagguuguuccggguaucccaauaugaaccuugacugccuguugccucaggaguggguccuacacuuuuaccaggaagcggcacccgcccagucagauguggcucugcucagguucguuaauccagacaccggccgggugcuguuugaguguaaacuucauaagaguggauauaucacugucgcccacacgggcccuuacgaucuggugauucccccaaacggguauuuccguuuugacagcuggguaaaccaauucuacacauuggcaccgaugggaaaugguaccggccgcagaagguga

SEQ ID NO: 21506 - RNA, 1614 nt, Artificial Sequence
  derived and/or modified sequence opt3 from VP1__Norovirus_and/or_Norovirus-like__LC016606
augaagauggccagcaacgacgcuucccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucacagugccuaucuuaaccgucgaggaaaugacgaauagccgcuuucccauaccacuggagaaacuuuucacuggacccuccucagcguucgugguucagccucagaacgguagauguaccacagauggcguguugcuggggacuacccaacuaaguccagucaauauuugcacauuuaggggagacgugacccauaucagcggcacgcacacuuaccggaugaaccucgccucucagaauuggaacaauuaugauccgacagaggaaauucccgcaccucuggguaccccagacuucguagggaagauccagggaaugcuuacucagacaaccaagggcgacggcuccacgcgcgggcauaaggcuaccguuucaacaggaagcguggauuuuacucccaaacuggguaguguccaauucgccaccgacacaaacaaugauuuugagacuggccagaacacccgauucacaccugugggggucauccaggacggaucugcucacagaaaugaaccacaacaguggguguugcccgauuacuccggcaagaccguucacaacgugcaucucgccccggcaguagccccuacuuuuccaggugagcagcuguuauucuuuaggagcacgaugcccggguguucgggcuacccuaauauggaccuggauugccuccuuccccaggaauggguccaacacuucuaucaggaggcugcgccagcacagucugacguggcccuguugcgguuuguuaacccugauacaggacgugugcuauucgaguguaaacugcauaagaccggcuacgucacuguggcucacaccgggcagcacgaccucguaauucccccaaauggauauuuucgcuucgauuccugggugaaccaauucuacacacuggccccgauggguaacggcgcagggagaaggcgguga

SEQ ID NO: 21507 - RNA, 1614 nt, Artificial Sequence
  derived and/or modified sequence opt3 from VP1__Norovirus_and/or_Norovirus-like__FJ537136
augaagauggccagcuccgacgcuaaccccucugauggcucagcagccaaucuggugccugaggucaacaaugaaguuauggcgcucgagccagugguaggggcugccaucgcagccccgguggcuggacagcaaaacauuauagaccccuggaucagaaauaacuucguccaggcaccugguggcgaauuuaccgugaguccaaggaaugcccccggggagauucuuuggagcgcuccucugggaccagauuugaaccccuacuuaucccaccugucucggauguauaauggcuacgccgguggguucgaaguucaggugauccuagcgggaaacgcauuuacagccggcaaagucauuuucgcugccgugccuccaaauuuuccgacugagggccucucgcccucacagguaacgauguucccucauaucauaguugacgugcgccaacuggagccaguccuuaucccccugccugaugugcgaaacaauuuuuaucacuacaaccagagccaugacaguaccuugaagcucauugcaaugcuguauacaccacugcgugcuaauaacgccggggaugacguguucacugucuccugcagaguucucaccaggcccucuccggauuuugacuucaucuuuuuagugccucccacaguagaaagccggaccaaaccauucacugugccuauucugacagucgaggaaauguccaacucacgcuuucccaucccacuugagaaguuguacaccggacccaguagcgcguucgugguucagccucagaaugguagauguacgacugauggcgugcugcuagggaccacacaacucucugccgucaacauaugcaauuucaggggagacgugacucacauuguaggcucccaugauuauaccaugaaccugguuucacagaauuggagcaacuacgacccaacagaggaaaucccggcaccccuugguaccccugacuuuguggggaaaauucagggacuguugacgcagacuacacgggcugauggcaguacccgcgcccacaaggcuacugucucuacaggcuccgugcacuucaccccaaagcucgggagcguccaauuuacgaccgacacaaauaacgauuuccagacuggacagaauaccaaauuuacacccguggguguuauccaagacggcgaucaucaccagaacgagccucagcagugggugcugccaaauuacucggggcgaacuggacauaacguacacuuagcccccgcagucgccccgaccuucccuggcgaacaacugcucuuuuucagaucuacaaugccagguuguuccggguaucccaauaugaaccuugacugccuguugccucaggagugggugcuacacuuuuaccaggaagcugcgcccgcacagucagauguugcccugcucagguucgugaauccagacaccggccggguccuguuugaguguaaacuucauaagaguggauauaucacuguggcucacacgggcccuuacgaucugguaauucccccaaacggguauuuccguuuugacagcugggugaaccaauucuacacauuggccccgaugggaaaugguaccggccgcagaagguga

SEQ ID NO: 21508 - RNA, 1614 nt, Artificial Sequence
  derived and/or modified sequence opt3 from VP1__Norovirus_and/or_Norovirus-like__AY532117
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcuugguccuuggggcgaauuuacaguuucaccaaggaacgcucccggggagauccuguggagugcaccuuugggaccagauuuaaaucccuaccugagccaccuagcccggauguauaacggcuacgcugguggguucgaagugcaggucauucucgccggaaaugcguuuacugcaggcaaaaucauuuucgccgcugugccuccaaacuuuccgacggagggccugucccccucucagguaaccauguucccucauaucauaguugacgugcgccagcuugagccaguccugauccccuugccugaugugcgaaauaacuuuuaucacuacaaucaaucgaacgacucaacaauuaagcucaucgccaugcuguauacuccacugcgugcaaacaaugcuggggaugacguguucaccgucagcugcagaguucucacaaggcccaguccggauuuugacuucaucuuuuuagugccucccaccguagaaucccggacuaaaccauucacagugccuauucugaccgucgaggaaaugucuaacagccgcuuucccauaccacuugagaaguuguacacgggacccuccucagccuucgugguucagccucagaaugguagauguacuaccgauggcgugcugcuagggacaacucagcucagugcggucaacauuugcaccuucaggggagacgugacacauaucgccggcagccacgauuauaccaugaaucuggcaucucaaaacuggaauaacuacgacccaacggaggaaauuccggcuccccuugguacuccugacuuuguagggaaaauccagggaguucugacacagaccacucgggaggauggcuccacacgcgcccauaaggcuaccgugucaacgggcagcguccacuucaccccaaaguuggggagugugcaguacacaacugacaccucuaaugauuuucaaacaggacagaacacuaaauucacccccgucggugugauccaggacggcaauaaccaccaaaaugaaccucagcaguggguucucccaaacuauuccgggcgaacaggacauaaugugcaccuggcccccgcaguagccccgaccuuuccuggcgagcaguuacuguucuuuagaagcacuaugccagguuguucgggguaccccaacaugaaccucgauugccuucugccucaagaauggguccagcauuucuaucaggaggcugcgcccgcacagucugacguggccuugcuaagguuuguuaauccagauacgggccgggugcuguucgaguguaagcuccacaaauccggauacgucacaguggcucacaccggcccuuaugaccugguaauucccccaaacggguacuuucguuucgauucaugggugaaucaauuuuauacucuugccccgaugggaaacggugcaggccgcagaagguga

SEQ ID NO: 21509 - RNA, 1614 nt, Artificial Sequence
  derived and/or modified sequence opt3 from VP1__Norovirus_and/or_Norovirus-like__KX514279
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaacuuuuccgacggagggccucucccccucucagguaaccauguucccucauaucauaguugacgugcgccaacuggagccaguccuuaucccccugccugaugugcgaaacaauuuuuaucacuacaaccagucgaaugacucaacaauuaaguugaucgcuaugcucuauacuccacugcgugccaacaaccccggggaugacguguucaccgucagcugcagaguucugacaaggccgaguccugauuuugacuucauuuuucucgugcccccaaccguagaaucccggacuaaaccuuucucugugcccaucuuaacagucggagagaugaccaauagccgcuuuccaauaaaccuggaaagacuuuucacgggucccuccucagcgaaugugguucagccucagaacgggagguguacuauugauggcgaguugcugggaaccacacaacuaaguagcgugaauaucugcacuuuccggggcgacgucacccagauugguucuacacaucacuggaccaugaaccucgccuccccaaauuggaacaauuacgauccgacggaggaaacucccgcaccucuggggacaccagacuuugugggaaagauccauggcaugcuuacccagacuacacaggagaacggcucaacccgcgcucaccgagccacgguauauguugggagcgcugacuucacccccaaacugggaaaggugcaauuugaaacagauacugaggacgauuuggccaucagacagaauaccaaguucacaccugucggugugauucagaguucugaccaccauagggaugaaccacaacaguggcggcuccccaacuacuccggcgcaaauacuuuuaacguccaccuggccccggcuguggcgccuaauuucccaggggagcaguuacuguuuuuccguagcacccuccccggauguggcggucauccuaacauggaccuugauugccuguugccccaggaguggguucaacacuuuuaccaggaagcagccccagcucagucggacguggcccuacugcgcuucguaaacccugauacaucuagaguccucuuugaguguaaacugcacaaguccggguaugugaccguugcacauacuggccaguacgaccuugugcugcccucaaauggauauuucagguuugauaguugggucaaccaauucuacacguuggccccaaugggcaaugggacaggacggcgacgcuga

SEQ ID NO: 21510 - RNA, 1614 nt, Artificial Sequence
  derived and/or modified sequence opt3 from VP1__Norovirus_and/or_Norovirus-like__LC016602
augaagauggccagcaacgacgcuucccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucacagugccuaucuuaaccgucgaggaaaugacgaauagccgcuuucccauaccacuggagaaacuuuucacuggacccuccucagcguucgugguucagccucagaacgguagauguaccacagauggcguguugcuggggacuacccaacuaaguccagucaauauuugcacauuuaggggagacgugacccauaucagcggcacgucuacuuaccggaugaaccucgccucccagaauuggaacaauuaugauccgacagaggaaauucccgcaccucuggguaccccagacuucguagggaagauccagggaaugcuuacucagacaaccaagggcgacggcucaacgcgcgggcacaaggcuaccguuagcacaggaaguguggauuuuacucccaaacuggguucuguccaauucgacaccgauacaaacaaugacuuggagacuggccagaacacccgauuuacaccugugggggucauccaggauggauccgcccauagaaaugaaccacaacagugggugcuccccgacuacagcggcaggaccguucacaacgugcaccuggcuccggccguagcaccuacuuucccaggugagcaguuacuguuuuuccggucgacgaugcccggguguucuggcuacccuaauauggaucucgacugccuucugccccaggaauggguccaacauuuuuaucaggaggccgcuccagcgcaguccgauguggcauugcuacguuucguuaacccugacacaggacgcgugcuguuugaguguaagcuccacaaaaccggcuacgucacuguggcccauaccgggcagcacgaucugguaauucccccaaauggauauuucagauuugacucaugggugaaccaauucuacacacuugcuccgauggguaacggcgccgggaggcggcgauga

SEQ ID NO: 21511 - RNA, 1614 nt, Artificial Sequence
  derived and/or modified sequence opt3 from VP1__Norovirus_and/or_Norovirus-like__AF145896
augaagauggccagcuccgacgcuaaccccucugauggcucagcagccaaucuggugccugaggucaacaaugaaguuauggcgcucgagccagugguaggggcugccaucgcagccccgguggcuggacagcaaaacauuauagaccccuggaucagaaauaacuucguccaggcaccugguggcgaauuuaccgugaguccaaggaaugcccccggggagauucuuuggagcgcuccucugggaccagauuugaaccccuacuuaucccaccugucucggauguauaauggcuacgccgguggguucgaaguucaggugauccuagcgggaaacgcauuuacagccggcaaagucauuuucgcugccgugccuccaaauuuuccgacugagggccucucgcccucacagguaacgauguucccucauaucauaguugacgugcgccaacuggagccaguccuuaucccccugccugaugugcgaaacaauuuuuaucacuacaaccagagccaugacaguaccuugaagcucauugcaaugcuguauacaccacugcgugcuaauaacgccggggaugacguguucacugucuccugcagaguucucaccaggcccucuccggauuuugacuucaucuuuuuagugccucccacaguagaaagccggaccaaaccauucacugugccuauucugacagucgaggaaauguccaacucacgcuuucccaucccacuugagaaguuguacaccggacccaguagcgcguucgugguucagccucagaaugguagauguacgacugauggcgugcugcuagggaccacacaacucucugccgucaacauaugcaauuucaggggagacgugacucacauuguaggcucccaugauuauaccaugaaccuggcaucacagaauuggagcaacuacgacccaacagaggaaaucccggcuccccuugguaccccugacuuuguugggaaaauucagggacuguugacgcagacuacacgggccgauggcaguacccgcgcucacaaggccacugugucuacaggcuccguccacuucaccccaaagcucgggagcgugcaauuuacgaccgacacaaauaacgauuuccagacuggacagaauaccaaauuuacacccgucggugugauccaagacggcgaucaucaccagaacgagccucagcaguggguucugccaaauuacucggggcgaacuggacauaacgugcacuuagcacccgccguagcuccgaccuucccuggcgaacaacugcucuuuuucagaucuacaaugccagguuguuccggguaucccaauaugaaccuugacugccuguugccucaggaguggguccuacacuuuuaccaggaagcggcacccgcccagucagauguggcucugcucagguucguuaauccagacaccggccgggugcuguuugaguguaaacuucauaagaguggauauaucacugucgcccacacgggcccuuucgaucuggugauucccccaaacggguacuuucguuucgacagcuggguaaaccaauucuauacauuggcaccgaugggaaaugguaccggccgcagaagguga

SEQ ID NO: 21512 - RNA, 1614 nt, Artificial Sequence
  derived and/or modified sequence opt3 from VP1__Norovirus_and/or_Norovirus-like__AB684704
augaagauggccagcuccgacgcuaaccccucugauggcucagcagccaaucuggugccugaggucaacaaugaaguuauggcgcucgagccagugguaggggcugccaucgcagccccgguggcuggacagcaaaacaucauagaccccuggaucagaaauaacuucguccaggcaccugguggcgaauuuaccgugaguccaaggaaugcccccggggagauucuuuggagcgcuccucuguccccagauuugaaccccuacuuaucucaccugucgcggauguauaauggauacgccggcgguuucgaaguucaggugauccuagcggggaacgcauuuacagccggaaaagucauuuucgcugccgugccuccaaauuuuccgacugagggccucucacccagccagguaacgauguucccucauaucauaguugacgugcgccaacuggagccaguccuuaucccccugccugaugugcgaaacaauuuuuaucacuacaaccaggcacaugacaguaccuugaagcucauugcuaugcuguauacaccacugcgugccaauaacgcgggcgaugacguguucacugucuccugcagaguucucaccaggcccucuccggauuuugacuucaucuuuuuagugccucccacaguagaaagccggaccaaaccauucacugugccuauucugacagucgaggaaauguccaacucaaaguuucccaucccacuugagaaauuguacaccgggcccaguagcgccuucgugguucagccucagaauggacgcuguacgacugauggugugcugcuaggcaccacacaacucucugcagucaacauaugcaauuucagaggggacgugacuaggguaggaaccucccacgauuauacaaugaaccugguuucacagaauuggaacaauuacgacccaaccgaggaaauuccggcuccccuuggcacgccugacuuuguggguaagauccaggggcuguugacucagacaacccgggccgauggaagcacucgcgcucauaaggccacagucaguaccggcucugugcacuucacgccaaaacucggcuccguccaauuuaccacagacacuaacaaugauuucgagaccgggcagaacacaaaguuuacucccgugggaguuauucaggacggugaucaccaucaaaaugaaccucagcagugggugcugccaagcuacucggggucuuccggccacaacguacauuuagcacccgccgucgcuccgaccuucccuggagagcagcugcucuuuuuccgaucaacaaugccaggcuguagugguuaucccaauaugaaccuugacugccuguugccucaagaaugggugcuacacuuuuaccaggaggcggcacccgcccagagcgauguugcucugcucagauucgugaauccagacaccgggaggguccuguuugaguguaaacuucacaaguccggcuauaucacuguggcccauacgggaccuuacgaucugguaauucccccaaacggcuauuuccgguuugacucuugggugaaccaguucuacacauuggcaccgauggggaauggaaccggucgucgcagauga

SEQ ID NO: 21513 - RNA, 1614 nt, Artificial Sequence
  derived and/or modified sequence opt3 from VP1__Norovirus_and/or_Norovirus-like__JX401279
augaagauggccagcuccgacgcuaaccccucugauggcucagcagccaaucuggugccugaggucaacaaugaaguuauggcgcucgagccagugguaggggcugccaucgcagccccgguggcuggacagcaaaacaucauagaccccuggaucagaaauaacuucguccaggcaccugguggcgaauuuaccgugaguccaaggaaugcccccggggagauucuuuggagcgcuccucugggaccagauuugaaccccuacuuaucccaccugucucggauguauaauggcuacgccgguggguucgaaguucaggugauccuagcgggaaacgcauuuacagccggcaaagucauuuucgcugccgugccuccaaauuuuccgacugagggccucucgcccucacagguaacgauguucccucauaucauaguugacgugcgccaacuggagccaguccuuaucccccugccugaugugcgaaacaauuuuuaucacuacaaccaggcacaugacagcaccuugaagcucauugcuaugcuguauacaccacugcgugccaauaacgcgggggaugacguguucacugucaguugcagaguucucaccaggcccuccccggauuuugacuucaucuuuuuagugccucccacaguagaaucucggaccaaaccauucacugugccuauucugacagucgaggaaaugagcaacucccgcuuucccaucccacuugagaaguuguacaccggacccucaagugccuucgugguucagccucagaaugguagauguacgacugauggcgugcugcuagggaccacacaacucagcgcagucaacauaugcaauuucaggggagacgugacucggguaggcaccucucacgauuauacaaugaaccugguuucccagaauuggaacaauuacgacccaaccgaggaaauuccggcuccccuugguacgccugacuuuguggggaaaauccagggacuguugacucagacaacccgcgccgauggcucaacucgagcucauaaggccacagucagcaccggcagugugcacuucacgccaaagcucgggucuguccaauuuaccacagacacugauaacgacuuccagaccggacagaauacaaaauuuacucccguggguguuauucaagauggcgaccaccaucagaacgagccucagcagugggugcugccaaauuacuccgggaccagcggacacaacguacauuuagcacccgccgucgcuccggcguucccuggcgaacaacugcucuuuuucagaucgacaaugccagguuguucuggguaucccaauaugaaccuugauugccuguugccucaggagugggugcuacacuuuuaccaggaagcagcccccgcucaguccgacguugcccugcucagguucgugaauccagauaccggccggguccuguuugaguguaaacuucacaagucaggauauaucacuguggcacauacgggcccuuacgaccugguaauucccccaaacggguauuuccguuuugauaguugggugaaccaauucuacacauuggccccgaugggaaaugguaccggccgcagaagguga

SEQ ID NO: 21514 - RNA, 1614 nt, Artificial Sequence
  derived and/or modified sequence opt3 from VP1__Norovirus_and/or_Norovirus-like__GQ389627
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacucaacaauuaaguugaucgcaaugcucuauacuccacugcgugcuaacaaugccggggaugacguguucaccgucagcugcagaguucugacaaggcccaguccggauuuugacuucauuuuucucgugccucccaccguagaaucccggacuaaaccauucacagugccuaucuuaaccgucgaggaaaugucuaacagccgcuuucccauaccacuggagaaacuuuacacgggacccuccucagcguucgugguucagccucagaaugguagauguacuaccgauggcguguugcuggggacaacucaacuaagugccgucaacauuugcaccuucaggggagacgugacacauaucgcaggcagccacgauuauaccaugaaucucgcuucucagaacugguccaauuacgacccaacggaggaaauuccggcuccccuggguacuccugacuuuguagggaagauccagggaaugcuuacacagaccacucgggaggauggcucaacacgcgcccauaaggccaccguuagcacgggcagugugcacuucaccccaaagcuggggucuguccaauacacaacugacaccaacaaugauuuucagacaggacagaacacuaaauucacccccgugggugucauccaagacggcaauaaccaccagaaugaaccucagcaguggguguugccaaacuauuccgggcgaacaggacauaauguucaccucgcacccgccguggcuccgaccuuuccuggcgagcaacuguuauucuuuagaagcacuaugccagguuguucgggguaccccaacaugaaccuggauugccuccuuccucaggaauggguacagcauuucugucaggaggcggcacccgcccaaucugacgucgcucuguugagguuugugaauccagauacgggccggguucuauucgagugcaagcugcacaaauccggauaugugacagucgcccacaccggcccucaugaccucgugauucccccaaacggguacuuucguuucgauucauggguaaaucaguuuuauacucuggcaccgaugggaaacggugccggccgcagaagguga

SEQ ID NO: 21515 - RNA, 1614 nt, Artificial Sequence
  derived and/or modified sequence opt3 from VP1__Norovirus_and/or_Norovirus-like__AF425763
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccuaggggugaauuuacaguuucaccacggaacgcacccggcgagauccuuuggagugccccucuggggccagauuugaaucccuacuuaagccaccuggcucgcauguauaacggauacgccggcgguuucgaagugcaggucauucuagcggggaaugcauuuacugccggaaaaaucauuuucgcugccgugccuccaaacuuuccgacggagggccucucccccucucagguaaccauguucccucauaucauaguugacgugcgacaacuggagccaguccuuaucccccugccugaugugcguaauaacuuuuaucacuacaaucagucgaacgacucaacaauuaaguugaucgcaaugccauauacuccccucagagcuaacaaugccggcgaugacguguucaccgucagcugcaggguucugacacggccgaguccugauuuugacuucauuuuucuggugcccccaaccguagaaucccgcacuaaaccuuucacagugcccauccucaccgucgaggaaaugucuaacagcagauuuccaauacccuuagagaagcuguacacggggccuuccucagcguucgugguucagccacagaauggaagguguacuaccgauggugugcuuuugggcacaacucaacugagugccgucaacauuugcaccuuccgcggggacgugacacauaucgcaggaagccacgauuauaccaugaaucuagcuucucagaacuggaauaacuacgacccgacggaggaaauucccgccccucucggcacuccagacuuuguagguaaaauccaggggaugcugacacagaccacucgggaggauggauccacacgagcucauaaggccaccguuucaacgggcagcgugcacuucacccccagacuuggcaguguccaauacacaacugacaccaauaacgauuuucagacagggcagaauacuaaguucaccccugugggagucauccaagacgguaacaaucaccagaacgaaccacagcagugggugcugcccaauuauucuggcaggacagggcauaacguucacuuggcaccggccguggcuccuaccuuuccaggagagcaacuccuguucuuucgguccacuaugcccggcuguagcgguuacccuaacaugaauuuagauugccugcucccccaggaauggguacagcauuucuaucaggaggcggcaccagcccaaucggacgucgcccuucugcguuuugugaacccugauacggggcgcguuuuguucgaguguaaacuacacaagucuggcuacgugacagucgcucacaccggaccccaugaccuggugauuccaccgaauggcuauuuuagauucgauuccuggguaaaccaguuuuacacucucgcaccuauggggaauggagccgguaggcggcgauga

SEQ ID NO: 21516 - RNA, 1614 nt, Artificial Sequence
  derived and/or modified sequence opt3 from VP1__Norovirus_and/or_Norovirus-like__AY532127
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugggcgaaauaacuuuuaucacuacaaucagucgaacgacucaacaauuaaguugaucgcaaugcucuauacuccacugcgugcuaacaaugccggagaugacguguucaccgugagcugcagaguccugacaaggcccaguccggauuuugacuucauuuuucucguuccucccaccguggaaucccggacuaaaccauucacaguaccuaucuuaaccguggaggaaaugucuaacagccgcuuucccauaccacuggagaaacuuuacacgggucccuccucagcguucgucgugcagccucagaauggcagauguacuaccgaugggguuuugcugggaacaacucaacuaagugccgugaacauuugcaccuucaggggcgacgucacacauaucgcagguagccacgauuauaccaugaaucucgcuucucagaacuggaauaacuacgacccaacggaggaaauuccggcuccccuggggacuccugacuuugugggaaagauccagggcacacuuacccagacuacacgggaggauggcuccacccgcgcccauaaggccacgguaucaaccgggagcguucacuucacaccaaagcugggaagugcacaauacacuaccgacacaaauaacgauuuucagacuggucagaauaccaaauucacacccgugggcgucauccaagacgggaacaaucaccagaacgaaccucagcaguggguguugccaaauuauucuggacgaaccggccauaacguccaccucgcccccgcuguggcgccgacuuuuccuggugagcaacuguuauucuuuagauccacgaugccaggguguagcggcuaccccaacaugaaucuggauugccuccuuccucaggaauggguucagcauuucuaucaggaggcagcccccgcucaaucggacguggcccuguugagguuuguaaacccagauacaggacggguccuauucgaguguaagcugcacaaaucuggcuacgugaccguugcacacacugggccucaugaccucgugauucccccaaauggauauuuucguuucgauuccugggucaaccaguuuuacacccuggccccgauggguaauggcgcugggcgcagaagguga

SEQ ID NO: 21517 - RNA, 1614 nt, Artificial Sequence
  derived and/or modified sequence opt3 from VP1__Norovirus_and/or_Norovirus-like__AY532118
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaauauuauagaccccuggaucagaaacaauuucguccaggcuccugguggcgaauuuacagugucaccaaggaacgcacccggggagauucuuuggagugccccucugggaccagauuugaaucccuacuuaagccaccuggcucggauguauaacggcuacgccgguggguucgaaguucaggugauccuagcgggaaaugcauuuacugccggcaaaauuaucuucgcugccgucccuccaaacuuuccgacggagggccucgggcccucccaggugaccauguucccucauauaaucguagacguucgccaacuggagccagugcuuauuccccugccugauguccgaaauaacuuuuaucacuacaaucagucuaacgacucgacaaucaaguugauugcaaugcucuauacuccacugcgugcuaacaaugccggagaugacguguucaccgugucaugcagaguccugacaaggcccagcccggauuuugacuucaucuuucucguuccucccaccguggaaagucggacuaaaccauucacaguaccuauauuaaccguggaggaaauguccaacucucgcuuucccgucccacuggagaaacuuuacacgggucccagcuccgcguucgugguucagccucagaauggcagauguacuaccgaugggguguugcugggaacaacucaacuaucagccgucaacauuugcaccuucaggggcgacgugacacauaucgcagguagucgggauuauaccaugaaucucgcuagccagaacuggaauaacuacgacccaacggaggaaauuccggcuccccuggggacuccugacuuuguaggaaagauccagggcguucuuacacagaccacucgcgaggauggcucuacacgagcccacaaggccaccguguccacggggucaguccauuucaccccaaagcugggaagcgugcaauacacaacugacaccgauaaugacuuucagacaggucagaacacuaaauucacccccgucggcgugauccaagaugggaauaaccaccagaaugaaccucagcaguggguuuugccaaacuauaguggaagacccggccacaaugugcaucucgcaccggccguagcuccuacauuucugggugagcaauuacuguucuuuaggucuaccaugccaggguguuccggcuaccccaacaugaaccucgacugccuucugccucaggaauggguccagcacuucuaucaggaggcggcacccgcccaaagcgauguggcuuugcuacgguuuguuaauccagacacuggacgugugcuguucgaguguaagcuccauaaaucgggcuacgucacgguggcccacacagggccucacgaucugguaauucccccaaacggauauuuucgcuucgacucuugggugaaucaguuuuacacccuugcaccgauggguaacggcgccgggagaaggcgguga

SEQ ID NO: 21518 - RNA, 1614 nt, Artificial Sequence
  derived and/or modified sequence opt3 from VP1__Norovirus_and/or_Norovirus-like__KX514326
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaucccggggaugacguguucacugucagcugcagaguucugaccaggccgaguccugauuuugacuucauuuuucucgugcccccaacaguagaaucccggaccaaaccuuucucugugcccaucuuaacugucggagagaugacaaacagccgcuuuccaauaaaucuggaaagacuuuucaccggucccuccucagcgaacgugguucagccucagaaugggagguguacgauugauggcgaguugcugggaacuacccaacuaaguagcgugaacaucugcacauuccggggcgacgucacucagauugguucuaccaagcauuggacaaugaaucucgccuccccaaacuggaauaacuacgauccgaccgaggaaacgcccgcaccucuggggacuccagacuuugugggaaaaauccacggcaugcuuacacagaccacucaggagaauggcucaacacgcgcucaucgagccaccguauauguugggggagcuaacuucacgcccaagcuggguaaggugcaauuugaaaccgacacagucgaugacuuggagaucagacagaauacuaaauucaccccugugggcgucauucagagcagugaucaccacagggacgaaccacaacaguggcggcuccccaacuacucuggggccaauacauuuaacgugcaucuggcaccggccguugcuccuaacuucccaggagagcaguuacuguuuuuccguuccacucuccccggcuguggugggcacccuaauauggaucuugacugccuguugccccaggagugggugcaacauuuuuaccaggaagcggcaccagcccagagcgauguagcucuacugcgcuucgucaacccugacaccucgagagugcucuuugaguguaagcugcacaaaucuggcuauguuacaguggcccacaccggacaguacgaucuuguccugcccuccaauggcuauuucagguuugacucaugggugaaccaauucuacacuuuggcaccaauggggaauggaacgggucggcgacgcuga

SEQ ID NO: 21519 - RNA, 1614 nt, Artificial Sequence
  derived and/or modified sequence opt3 from VP1__Norovirus_and/or_Norovirus-like__KX514264
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaucccggggaugacguguucacugucagcugcagaguucugaccaggccgaguccugauuuugacuucauuuuucucgugcccccaacaguagaaucccggaccaaaccuuucucugugcccaucuuaacugucggagagaugacaaacagccgcuuuccagugaaucuggaaagacuuuucaccggucccuccucagcgaacguugugcagccucagaaugggagguguacgauagauggcgaguugcugggaacuacccaacuaaguagcgucaacauuugcacauuccggggcgacgugacucauaucgguucuacccaccauuggacaaugaaucucgccuccccaaacuggaauaacuacgauccgaccgaggaaacgcccgcaccucuggggacuccagacuuuguaggaaagauucacggcaugcuuacacagaccacucagggcucagggagcacacgcgcucaccgagccaccguuuaugugggaagugcugaguucacgcccaaacuggguaagguccaguuucaaaccgaaacagaggacgauuuggugaucagacagaauacuaaguucaccccugucggcgugauccaggaaucugaccaucacagggaugagccacaacaguggcggcuccccaacuacuccggggccaauacauuuaacguucaucuggcaccggccguggcuccuaauuucccaggagagcaguuacuguuuuuccguagcacuauucccggcuguggugggcacccuaacaugaaccucgacugccuucugccccaggaauggguacaacacuuuuaccaggaggcggcaccagcccagucggaugucgcuuugcuacgcuucgugaauccugacaccucuagaguucuguuugaauguaaacuccauaaguccggcuaugugacagucgcccacaccggacagcaugaucuggugauacccccaaacggcuacuucagguuugacucauggguaaaucaauucuauacucuugcaccgauggggaacggaacgggucggaaacgauga

SEQ ID NO: 21520 - RNA, 1614 nt, Artificial Sequence
  derived and/or modified sequence opt3 from VP1__Norovirus_and/or_Norovirus-like__KX514171
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaacuuuuccgacggagggccucucccccucucagguaaccauguucccucauaucauaguugacgugcgccaacuggagccaguccuuaucccccugccugaugugcgaaacaauuuuuaucacuacaaccagucgaaugacucaacaauuaaguugaucgcuaugcucuauacuccacugcgugccaacaaccccggggaugacguguucaccgucagcugcagaguucugacaaggccgaguccugauuuugacuucauuuuucucgugcccccaaccguagaaucccggacuaaaccuuucucugugcccaucuuaacagucggagagaugaccaauagccgcuuuccagugaaccuggaaagacuuuucacgggucccuccucagcgaauguugugcagccucagaacgggagguguacuauagauggcgaguugcugggaaccacacaacuaaguagcgucaauauuugcacuuuccggggcgacgugacccauaucgguacaacccagcacuggacgaugaaccucgccucuccaaauuggaacaauuacgauccgacugaggaaacacccgcaccucuggggaccccagacuuuguaggaaagauucauggcaugcuuacucagacaacccagggcuccgggucaacgcgcgcucaccgagccaccguuuaugugggaagcgcugaguucacacccaaacuggguaaggucagauuugaaacugacaccgaggaugacuuggugaucaggcaaaacacaaaguucacuccugucggcgugauccagaguucugaacaccaucgggaugagccacagcaauggcgucuccccaauuacuccggggccaacaccuuuaauguucaccuggcaccggccguggcuccuaacuucccaggagagcaguuacuguuuuuccgcagcacacuccccggcuguggugggcauccuaauauggaccuugauugccuguugccccaggaauggguacagcacuuuuaccaagaggcggcaccagcccagucggacgucgcucuacugagauucgugaacccugauaccucuaggguucucuuugaauguaaacugcacaaguccggcuaugugacugucgcccauacgggacaguacgaccuugugcugcccucaaacggcuauuuccgguuugauaguuggguaaaucaguucuacacauuggcaccaauggggaacggaaccggucgacgcagauga

SEQ ID NO: 21521 - RNA, 1614 nt, Artificial Sequence
  derived and/or modified sequence opt3 from VP1__Norovirus_and/or_Norovirus-like__KX514170
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaacuuuuccgacggagggccucucccccucucagguaaccauguucccucauaucauaguugacgugcgccaacuggagccaguccuuaucccccugccugaugugcgaaacaauuuuuaucacuacaaccagucgaaugacucaacaauuaaguugaucgcuaugcucuauacuccacugcgugccaacaaccccggggaugacguguucaccgucagcugcagaguucugacaaggccgaguccugauuuugacuucauuuuucucgugcccccaaccguagaaucccggacuaaaccuuucucugugcccaucuuaacagucggagagaugaccaauagccgcuuuccagugaaccuggaaagacuuuucacgggucccuccucagcgaauguugugcagccucagaacgggagguguacuauagauggcgaguugcugggaaccacacaacuaaguagcgucaauauuugcacuuuccggggcgacgugacccauaucgguacaacccagcacuggauuaugaaccucgccucuccaaauuggaacaauuacgauccgacggaggaaacucccgcaccucuggggacaccagacuuuguaggaaagauccauggcaugcuuacccagacuacacagggcuccgggucaacccgcgcucaccgagccacgguuuaugugggaagcgcugaguucacccccaaacuggguaaggucagauuugaaacagacacugaggaugacuuggugaucaggcaaaacaccaaguucacaccugucggcgugauucagaguucugaacaccaucgggaugagccacagcaauggcgucuccccaauuacuccggggccaacacuuuuaauguucaccuggcaccggccguggcuccuaacuucccaggagagcaguuacuguuuuuccgcagcacccuccccggcuguggugggcauccuaauauggaccuugauugccuguugccccaggaauggguacagcacuuuuaccaagaggcggcaccagcccagucggacgucgcucuacugagauucgugaacccugauacaucuaggguucucuuugaauguaaacugcacaaguccggcuaugugaccgucgcccauacuggacaguacgaccuugugcugcccucaaacggcuauuuccgguuugauaguuggguaaaucaguucuacacguuggcaccaauggggaacggaacaggucgacgcagauga

SEQ ID NO: 21522 - RNA, 1614 nt, Artificial Sequence
  derived and/or modified sequence opt3 from VP1__Norovirus_and/or_Norovirus-like__KF806533
augaagauggccagcaacgacgcuucccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucguuguggacguccgccaacuggagccagugcuuauaccccugccugaugugcgaaacaauuuuuaucacuacaaccagucaaaggacccaaccaucaaauugauugcuaugcucuauacaccccugcgugccaauaacgcgggggaagaugucuucacuguuagcugcagagugcugaccaggccgaguccugacuuugauuucaucuuucucguacccccaacaguggagucccggucuaagccuuucaccguccccauuuuaacuguggaagagaugacaaacagccgcuuuccaaucccccuggagaaacuuuucaccggaccuuccucagccuucguugugcagccacagaaugguagauguacgacugacggcgucuugcuggggaccacacaacuaaguccggugaacauaugcacuuuuaggggagaucucacccauuucgcaggcacacacgaauacgcuaugaaucuggccagccagaacuggaccaauuaugaccccacggaggaaauuccugcuccacuuggugcccccgauuuuguagggaagauccggggaguucugacucagacaacccgcggcgacggcucuacucgagggcauagagcaacauuguccaccggaucagcccacuucacgccuaagcucgguagcgugagguuuaguaccgacacaaacaaugauuucgaggcuggccagaacacuaaauuuaccccagucgggguguuccaagacggagauaaucaccagaacgaaccccagcaauggguccugccgaauuacucuggcgcgacagcacauaacgugcacuuagccccugcuguugccccagcauuucccggugagcagcuccucuucuuucgguccacuaugccuggguguagcggcuaccccaauaugaaccuugacugccuguugccacaggagugggugcagcauuucuaucaagaagccgcuccugcccagucggauguagcacuacugcguuuugucaaucccgacaccucucgcgugcuguucgaguguaagcugcacaaauccggauacguuacaguggcgcacaccggccagcaugaucuugucauuccaccgaacggguauuucagauuugacucaugggugaaccaguucuacacucuggcuccuaugggaaaugguacgggcaggcggcgauga

SEQ ID NO: 21523 - RNA, 1614 nt, Artificial Sequence
  derived and/or modified sequence opt3 from VP1__Norovirus_and/or_Norovirus-like__KF806528
augaagauggccagcaacgacgcuucccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucguuguggacguccgccaacuggagccagugcuuauaccccugccugaugugcgaaacaauuuuuaucacuacaaccagucaaaggacccaaccaucaaauugauugcuaugcucuauacaccccugcgugccaauaacgcgugggaagaugucuucacuguuagcugcagagugcugaccaggccgaguccugacuuugauuucaucuuucucguacccccaacaguggagucccggucuaagccuuucaccguccccauuuuaacuguggaagagaugacaaacagccgcuuuccaaucccccuggagaaacuuuucaccgggccuuccggagccuucguugugcagccacagaaugguagauguacgacugacggcgucuugcuggggaccacacaacuaucaccggugaacauaugcacuuuuaggggagaucucacccauuucgcaggcacacacgaauacgcuaugaaucuggccagucagaacuggaauaacuaugaccccaccgaggaaauuccugcuccacuuggugcccccgauuuuguagggaagauccggggaguucugacgcagacuacacgccgagacggcagcaccagaggccauagggcaacuuugucuacaggguccgcccacuucaccccuaagcucggaucaauucgguuuagcacggacaccaauaacgauuucgaggcuggucagaauacaaaauuuacuccagugggcgucuuccaagacggggauaaccaccagaaugaaccccagcaaugggugcugccgaacuacaguggagcgaccgcacauaauguccacuuagccccugcuguggccccagcauuucccggcgagcagcuccuguucuuucguucuacaaugccugguuguuccggguaccccaacaugaaucuugacugccuguugccacaggaguggguucagcauuucuaucaagaagccgcuccugcccagagcgauguggcacuacugcgcuuuguaaaccccgacacuucgagaguccucuucgaguguaagcugcacaaaucuggcuacgugaccguugcgcacacaggacagcaugaucuugugaucccaccgaacggcuauuucagguuugacuccugggucaaucaguucuacacccuggcuccuauggggaacggaacuggucggcgacgcuga

SEQ ID NO: 21524 - RNA, 1614 nt, Artificial Sequence
  derived and/or modified sequence opt3 from VP1__Norovirus_and/or_Norovirus-like__KF806527
augaagauggccagcaacgacgcuucccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucguuguggacguccgccaacuggagccagugcuuauaccccugccugaugugcgaaacaauuuuuaucacuacaaccagucaaaggacccaaccaucaaauugauugcuaugcucuauacaccccugcgugccaauaacgcgggggaagaugucuucacuguuagcugcagagugcugaccaggccgaguccugacuuugauuucaucuuucucguacccccaacaguggagucccggucuaagccuuucaccguccccauuuuaacuguggaagagaugacaaacagccgcuuuccaaucccccuggagaaacuuuucaccggaccuuccucagccuucguugugcagccacagaaugguagauguacgacugacggcgucuugcuggggaccacacaacuaaguccggugaacauaugcacuuuuaggggagaucucacccauuucgcaggcacaagcgaauacgcuaugaaucuggccucucagaacuggaccaauuaugaccccacggaggaaauuccugcuccacuuggugcccccgauuuuguagggaagauccggggaguucugacucagacaacccgcggcgacggcuccacucgagggcacagagcaacauugucaaccggaagcgcccauuucacgccuaagcucgguagugugagguuuucuaccgacacaaacaaugauuucgaggcuggccagaacacuaaauuuaccccagucgggguguuccaagacggagauaaucaccagaacgaaccccagcaauggguccugccgaauuacuccggcgcgacagcacacaacgugcauuuagccccugcuguugccccagcauuucccggugagcagcuccucuucuuucggagcacuaugccuggguguucgggcuaccccaauaugaaccuugacugccuguugccacaggagugggugcagcacuucuaucaagaagccgcuccugcccagucugauguagcacuacugcguuuugucaaucccgacaccucccgcgugcuguucgaguguaagcugcauaaaucaggauacguuacaguggcgcacaccggccagcacgaucuugucauuccaccgaacggguauuucagauuugacaguugggugaaccaguucuacacucuggcuccuaugggaaaugguacgggcaggcggcgauga

SEQ ID NO: 21525 - RNA, 1614 nt, Artificial Sequence
  derived and/or modified sequence opt3 from VP1__Norovirus_and/or_Norovirus-like__KX514261
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaacuuuuccgacggagggccucucucccucgcagguaaccauguucccucauaucauaguugacgugcgccaacuggagccaguccuuaucccccugccugaugugcgaaauaacuuuuaucacuacaaucagucaaacgacagcacaauuaaguugaucgcuaugcucuauacuccacugcgugccaauaaccccggggaugacguguucaccgucaguugcagaguucugacaaggccguccccugauuuugacuucauuuuucucgugcccccaaccguagaaucucggacuaaaccuuucagcgugcccaucuuaacagucggagagaugaccaacucccgcuuuccagugaaucuggaaagacuuuucacgggucccucaagugcgaacguugugcagccucagaaugggagguguacuauagauggcgaguugcugggaaccacacaacuaagcucugucaacauuugcacuuuccggggcgacgugacccauaucgguuccacacaccauuggaccaugaaucucgccucaccaaacuggaauaacuacgauccgacggaggaaacucccgcaccucuggggacaccagacuuuguaggaaagauucacggcaugcuuacccagacuacacagggcagcgggaguacccgcgcucaccgagccacgguuuaugugggaucugcugaguucacccccaaacuggguaagguccaguuucaaacagaaacugaggacgauuuggugaucagacagaauaccaaguucacaccugucggcgugauccaggaauccgaccaucacagggaugagccacaacaguggcggcuccccaacuacagcggggccaauacuuuuaacguucaucuggcaccggccguggcuccuaauuucccaggagagcaguuacuguuuuuccguucgacccuccccggcuguggugggcacccuaacauggaccuugauugccuguugccccaggaauggguacaacacuuuuaccaggaggcggcaccagcccagucugacgucgcucuacugcgcuucgugaauccugauacauccagaguucucuuugaauguaaacugcauaagucaggcuaugugaccgucgcccacacuggacaguacgaccuugugcugcccaguaacggcuauuucagguuugauagcuggguaaaccaauucuacacguuggcaccaauggggaauggaacaggucggcgacgcuga

SEQ ID NO: 21526 - RNA, 1614 nt, Artificial Sequence
  derived and/or modified sequence opt3 from VP1__Norovirus_and/or_Norovirus-like__AB684720
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccugucucggauguauaauggcuacgcugguggguucgaagugcaggucauucuagccggaaacgcguuuacugcaggcaaaaucauuuucgccgcugugccuccaaauuuuccgacggagggccucucgcccucacagguaaccauguucccucauaucauaguugacgugcgccaacuggagccaguccuuaucccccugccugaugugcgaaacaauuuuuaucacuacaaccaggcccaugacagcacauugaagcucauugcaaugcuguauacuccacugcgugcuaauaacgccggggaugacguguucaccgucaguugcagaguucucacaaggcccuccccggauuuugacuucaucuuuuuagugccucccaccguagaaucucggacuaaaccauucagcgugccuauucugacagucgaggaaauguccaacucacgcuuucccaucccacuugagaaguuguacaccggacccaguagcgcguucgugguucagccucagaaugguagauguacgacugauggcgugcugcuagggaccacacaacucucugccgucaacauaugcaauuucaggggagacgugacucacauucggggcucccgcgauuauaccaugaaccugguaucacagaauuggaacaauuacgacccaacagaggaaaucccggcaccccuugguaccccugacuuuguugggaaaauucagggacuguugacgcagacuacacgagcugauggcagcaccagagcccauaaggcuacugugaguacaggcucuguccacuucaccccaaagcucggguccgugcaauuuacgaccgacacagauaacgacuuccagacuggacagaauaccaaauuuacacccgucggugugauccaagauagcgaccaccaucagaacgagccucagcaguggguucugccaaauuacucgggcgccucugggcacaacgugcauuuagcacccgccguagcuccgacuuucccuggagaacaacugcucuuuuucagguccaccaugccaggcuguucagguuaucccaauaugaaccuugauugccuguugccucaggaguggguccuacacuuuuaccaggaagcggcacccgcccagagugacguggcucugcuccgguucguuaauccagauacagggcgugugcuguuugaguguaaacuucacaagagcggcuauaucaccgucgcccauacuggaccuuacgaccuggugauucccccaaacggcuauuuccgcuuugauuccuggguaaaccaauucuacacguuggcaccgauggggaauggaacagguagaaggcgguga

SEQ ID NO: 21527 - RNA, 1614 nt, Artificial Sequence
  derived and/or modified sequence opt3 from VP1__Norovirus_and/or_Norovirus-like__LC016605
augaagauggccagcaacgacgcuucccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagaucaccauguucccucauauaaucguagacguucgccaacuggagccagugcuuauuccccugccugauguccgaaacaauuuuuaucacuacaaccagucaaaugacagcacaaucaaguugauugcaaugcucuauacuccacugcgugcuaacaacgccggggaugacguguucaccgugaguugcagaguccugacaaggcccuccccggauuuugacuucaucuuucucguuccucccaccguggaaucucggacuaaaccauucacaguaccuauauuaaccguggaggaaaugacgaauagccgcuuucccauuccacuggagaaacuuuucacuggacccuccucagcguucgucgugcagccucagaacgguagauguaccacagauggcguuuugcuggggacuacccaacuaaguccagugaauaucugcacauuuaggggagacgucacccauauuccgggcacgcggacuuaccgcaugaaccucgccagccagaauuggaacaauuaugaucccacagaggaaaucccugcaccacuggguacccccgacuucguggggaagauccagggaaugcuuacucagacaaccaagggcgacggcucuacgcgagggcacaaggcuaccguauccacaggaucaguugauuuuacuccuaaacuggguagcgugcaauucgacaccgauacaaacaaugacuuggagacuggccagaacaccagauuuacaccagucggggugauucaggauggaagugcccauaggaaugaaccccaacaguggguccucccggacuacucuggccggaccgugcacaacguucaccuggcuccugccguggcaccaacuuuccccggugagcaguuacuguuuuuccguuccacgaugccuggguguagcggcuaccccaauauggaucucgacugccuucugccacaggaauggguacaacauuuuuaucaggaggccgcuccugcgcagucggaugucgcauugcuacgcuucgugaaccccgacacaggaagaguucuguuugaguguaagcuccacaaaaccggcuacgugacugucgcccauaccgggcagcacgaucuggugauaccaccgaauggauauuucagguuugacucuuggguaaaccaauucuacacacuugcuccuauggguaacggcgccgggcggcgacgcuga

SEQ ID NO: 21528 - RNA, 1614 nt, Artificial Sequence
  derived and/or modified sequence opt3 from VP1__Norovirus_and/or_Norovirus-like__KF806529
augaagauggccagcaacgacgcuucccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucguuguggacguccgccaacuggagccagugcuuauaccccugccugaugugcgaaacaauuuuuaucacuacaaccagucaaaggacccaaccaucaaauugauugcuaugcucuauacaccccugcgugccaauaacgcgggggaagaugucuucacuguuagcugcagagugcugaccaggccgaguccugacuuugauuucaucuuucucguacccccaacaguggagucccggucuaagccuuucaccguccccauuuuaacuguggaagagaugacaaacagccgcuuuccaaucccccuggagaaacuuuucaccggaccuuccggugccuucguugugcagccacagaauggcagauguacgacugacggggucuugcugggaaccacacaacuaucaccggugaacauaugcacuuuuaggggcgaucucacccauuucgcagguacacacgaauacgcuaugaaucuggccagucagaacuggagcaauuaugaccccaccgaggaaauuccugcuccacuuggggcccccgauuuuguaggaaagauccggggcguucugacgcagacuacacgcggcgacgggucuacccgaggacauagagcaacuuuguccacagguucagcccacuucaccccuaagcucggcagcauuagguuuaguacggacaccaacaaugauuucgaggcugggcagaacacaaaauuuacuccagugggagucuuccaagacggcgauaaucaccagaacgaaccccagcaaugggugcugccgaauuacucuggugcgaccgcacauaacguccacuuagccccugcuguggccccagcauuucccggggagcagcuccuguucuuucgguccacaaugccuggcuguagcggauaccccgacaugaaucuugauugccuguugccacaggaguggguucagcauuucuaucaagaagccgcuccugcccagucggacguggcacuacugcguuuuguaaaccccgauacuucucgcguccucuucgaguguaagcugcacaaauccggcuacgugaccguugcgcacacagggcagcaugaccuugugaucccaccgaauggauauuucagauuugauucaugggucaaccaguucuacacccuggcuccuauggguaacggcacugggaggcggcgauga

SEQ ID NO: 21529 - RNA, 1614 nt, Artificial Sequence
  derived and/or modified sequence opt3 from VP1__Norovirus_and/or_Norovirus-like__JX023286
augaagauggccagcuccgacgcuaaccccucugauggcucagcagccaaucuggugccugaggucaacaaugaaguuauggcgcucgagccagugguaggggcugccaucgcagccccgguggcuggacagcaaaacauuauagaccccuggaucagaaauaacuucguccaggcaccugguggcgaauuuaccgugaguccaaggaaugcccccggggagauucuuuggagcgcuccucugggaccagauuugaaccccuacuuaucccaccugucucggauguauaauggcuacgccgguggguucgaaguucaggugauccuagcgggaaacgcauuuacagccggcaaagucauuuucgcugccgugccuccaaauuuuccgacugagggccucucgcccucacagguaacgauguucccucauaucauaguugacgugcgccaacuggagccaguccuuaucccccugccugaugugcgaaacaauuuuuaucacuacaaccaggcacaugacagcaccuugaagcucauugcuaugcuguauacaccacugcgugccaauaacgcgggggaugacguguucacugucaguugcagaguucucaccaggcccuccccggauuuugacuucaucuuuuuagugccucccacaguagaaucucggaccaaaccauucacugugccuauucugacagucgaggaaaugagcaacucccgcuuucccaucccacuugagaaguuguacaccggacccucaagugccuucgugguucagccucagaaugguagauguacgacugauggcgugcugcuagggaccacacaacucagcgcagucaacauaugcaauuucaggggagacgugacucggguaggcauuucucacgauuauaccaugaaccugguuucccagaauuggaacaauuacgacccaacagaggaaaucccggcuccccuugguaccccugacuuuguggggaaaauucagggacuguugacgcagacuacacgcgccgauggcucaacccgagcucauaaggccacugucagcacaggcagugugcacuucaccccaaagcucgggucuguccaauuuacgaccgacacaaacaaugauuuccagacuggacagaacaccaaauuuacacccguggguguuauccaagacggcgaucaccaucagaaugagccucagcagugggugcugccaaacuacuccgggacuagcggacacaauguacauuuagcacccgccgucgcuccgaccuucccuggcgaacaacugcucuuuuucagaucgacaaugccagguuguucuggguaucccaacaugaaucuugacugccuguugccucaggagugggugcuacacuuuuaccaggaagcggcacccgcccaguccgauguugcucugcucagguucgugaacccagacaccggccggguccuguuugaguguaaacuucacaagucaggauauaucacuguggcccauacgggcccuuacgaucugguaauucccccaaacggguauuuccguuuugacaguugggugaaucaauucuacacauuggcaccgaugggaaacgguaccggccgcagaagguga

SEQ ID NO: 21530 - RNA, 1614 nt, Artificial Sequence
  derived and/or modified sequence opt3 from VP1__Norovirus_and/or_Norovirus-like__FJ537137
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccugucccggauguauaacggcuacgccgguggguucgaagugcaggucauucuagcgggaaaugcauuuacagccggcaaagugaucuucgcugccguaccuccaaacuuuccgacugagggccucucucccucgcagguuacgauguucccucauauuaucguggacguccgccaacuggagccagugcuuauaccccugccugaugugcgaaauaacuuuuaucacuacaaucaggcacaugacucaaccuugaagcucaucgcuaugcuguauacaccacugcgugccaacaacgcgggggaugacgucuucacuguuagcugcagagugcucaccaggcccaguccggauuuugacuucaucuuuuuaguaccucccacaguggaaucccggaccaaaccauucacugucccuauucugacaguggaggaaaugucuaauagccgcuuucccauuccacuugagaaguuguacaccggacccuccucagccuucguugugcagccucagaacgguagauguacgacugauggcguccugcuagggaccacacaacucagugcagugaauaucugcaacuucaggggagacguaacucacauaguuggcagccaugauuauaccaugaaucuggugucucagaacugguccaauuacgacccaacagaggaaauuccggcuccccuugguaccccugacuuugucgggaaaauccagggacuguugacgcagacuacacgggccgauggcucaacccgcgcucacaaggccacugugagcacaggcaguguccacuucauuccaaagcucgggucugugcaauuuaccacggacaccaacaaugauuuccagacaggacagaacacuaaauuuacccccguuggugugauccaagacggcgaucaucaccagaaugagccucagcaguggguacugccaaacuacuccgggcgaacaggacauaauguccacuuagcacccgccguggcuccgacuuucccuggcgaacaacugcucuuuuucagaagcaccguuccagguuguucgggguaucccaacaugaaucuugacugccuguugccucaggagugggugucucacuuuuaccaggaagcggcacccgcccaguccgaugucgcucuacugagguucgugaacccagacacaggccggguacucuuugaguguaagcugcauaaaucaggauauaucaccguggcccacacuggcccuuacgaucuuguucugcccccaaacggguauuuccguuuugacaguugggucaaucaauucuacacguuggcaccgaugggaaacgguacaggccgcagaagguga

SEQ ID NO: 21531 - RNA, 1614 nt, Artificial Sequence
  derived and/or modified sequence opt3 from VP1__Norovirus_and/or_Norovirus-like__X76716
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccugucccggauguauaacggcuacgccgguggguucgaagugcaggucauucuagcgggaaaugcauuuacagccggcaaagugaucuucgcugccguaccuccaaacuuuccgacugagggccucucucccucgcagguuacgauguucccucauauuaucguggacguccgccaacuggagccagugcuuauaccccugccugaugugcgaaauaacuuuuaucacuacaaucaggcaaacgacucaaccuugaagcucaucgcuaugcuguauacaccacugcgugccaacaaugcgggggaugacgucuucacuguuagcugcagagugcucaccaggcccaguccggauuuugacuucaucuuuuuaguaccucccacaguggaaucccggaccaaaccauucacugucccugugcugacaguugaggaaaugucuaacagccgcuuucccauuccacuugagaaguuguacaccggacccuccucagccuucgugguccagccucagaaugguagauguacgacugauggcgugcugcuagggaccacacaacucagugcaguaaacauuugcaauuucaggggagacguuacucauaucgcuggcagccacgauuauaccaugaaccuggccucucagaauugguccaacuacgacccaacagaggaaauaccggcuccccuugguaccccugacuuuguggggaaaauucagggacuguugacgcagacuacacgggccgauggcucaacccgcgcacauaaggccacugucagcacaggcagugugcacuucaccccaaagcucgggucuguccaauuuacgaccgacacaaauaacgauuuccaggcuggacagaauacuaaauuuacccccguggguguuauccaagacggcgaucaccaucagaacgagccucagcaguggcuguuaccaaauuacuccgggcgaacaggacacaacgugcaucuggcgcccgcaguagccccgacuuucccuggcgaacaacuccucuuuuucagaagcaccaugccagguuguucgggguaucccaauaugaaccuggacugcuugcuaccucaggaguggguccugcacuuuuaccaggaagcugcccccgcacagucugauguggcccuccugagguucguuaacccagacacaggccgggugcuuuuugaguguaagcugcacaaauccggauauauuaccgucgcucauacuggcccuuacgauuuggugcuucccccaaauggguauuuccguuuugacucauggguaaaccaauucuacacgcuggccccgaugggaaaugguacaggccgcagaagguga

SEQ ID NO: 21532 - RNA, 1614 nt, Artificial Sequence
  derived and/or modified sequence opt3 from VP1__Norovirus_and/or_Norovirus-like__KX514328
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaacuuuuccgacggagggccucucccccucucagguaaccauguucccucauaucauaguugacgugcgccaacuggagccaguccuuaucccccugccugaugugcgaaacaauuuuuaucacuacaaccagucgaaugacucaacaauuaaguugaucgcuaugcucuauacuccacugcgugccaacaaccccggggaugacguguucaccgucagcugcagaguucugacaaggccgaguccugauuuugacuucauuuuucucgugcccccaaccguagaaucccggacuaaaccuuucucugugcccaucuuaacagucggagagaugaccaauagccgcuuuccaauaaaccuggaaagacuuuucacgggucccuccucagcgaaugugguucagccucagaacgggagguguacuauugauggcgaguugcugggaaccacacaacuaaguagcgugaauaucugcacuuuccggggcgacgucacccagauugguucuacaaagcauuggaccaugaaccucgccuccccaaauuggaacaauuacgauccgacggaggaaacucccgcaccucuggggacaccagacuuugugggaaaaauccacggcaugcuuacccagacuacacaggagaacggcucaacccgcgcucaucgagccacgguauauguugggggagcuaauuucacccccaagcuggguaaggugcaauuugaaacagacacugucgaugacuuggagaucagacagaacaccaaauucacaccugugggcgucauucagagcagugaucaccacagggacgaaccacaacaguggcggcuccccaauuacucuggggccaacacuuuuaaugugcaucuggcaccggccguugcuccuaacuucccaggagagcaguuacuguuuuuccguuccacccuccccggcuguggugggcacccuaacauggaucuugacugccuguugccccaggagugggugcaacauuuuuaccaggaagcggcaccagcccagagcgauguagcucuacugcgcuucgucaauccugacacaucgagagugcucuuugaguguaagcugcacaaaucuggcuauguuaccguggcccacacuggacaguacgaucuuguccugcccuccaacggcuauuucagguuugacucaugggugaaucaauucuacacguuggcaccaauggggaacggaacaggucggcgacgcuga

SEQ ID NO: 21533 - RNA, 1614 nt, Artificial Sequence
  derived and/or modified sequence opt3 from VP1__Norovirus_and/or_Norovirus-like__KX514201
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaacuuuuccgacggagggccucucucccucgcagguaaccauguucccucauguuaucguggacguccgccaacuggagccagugcuuauaccccugccugaugugcgaaauaacuuuuaucacuacaaucagucaaacgacagcacaaucaaguugauugcuaugcucuauacuccacugcgugccaauaaccccggggaugacgucuucaccguuaguugcagagugcugacaaggccguccccugauuuugacuucaucuuucucguacccccaaccguggaaucucggacuaaaccuuucagcguccccauuuuaacagugggagagaugaccaacucccgcuuuccaaucaaucuggaaagacuuuucacgggucccucaagugcgaacguugugcagccucagaaugggagguguacuauagauggcgaguugcugggaaccacacaacuaagcucugucaacauuugcacuuuccggggcgacgugacccauaucgguuccacacaccauuggaccaugaaucucgccucaccaaacuggaauaacuacgauccgacggaggaaacucccgcaccucuggggacaccagacuuuguaggaaagauucacggcaugcuuacccagacuacacagggcagcgggaguacccgcgcucaccgagccacgguuuaugugggaucugcugaguucacccccaaacuggguaagguccaguuuaagacagaaacugaccaugauuugaccaucagacaaaauacaaaauucacuccugugggcgucauccaggaguccgaccaccauagggaugaaccacagcaauggcggcuccccaacuacagcggggccaauaccuuuaacgugcaccuggcaccggccguugcuccuaauuucccaggagagcaguuacuguuuuuccguucgacacuccccggcuguggugggcacccuaacauggaccuugauugccuguugccccaggagugggugcagcauuuuuaccaagaagcggcaccagcccagucugacguagcucuacugcgcuucgucaauccugauaccuccagagugcucuuugaguguaagcugcacaaaucaggcuauguuacuguggcccauacgggacaguacgaccuuguccugcccaguaacggcuauuucagguuugauagcugggugaaccaguucuacacauuggcaccaauggggaauggaaccggucggcgacgcuga

SEQ ID NO: 21534 - RNA, 1614 nt, Artificial Sequence
  derived and/or modified sequence opt3 from VP1__Norovirus_and/or_Norovirus-like__AB985442
augaagauggccagcuccgacgcuaaccccucugauggcucagcagccaaucuggugccugaggucaacaaugaaguuauggcgcucgagccagugguaggggcugccaucgcagccccgguggcuggacagcaaaacauuauagaccccuggaucagaaauaacuucguccaggcaccugguggcgaauuuaccgugaguccaaggaaugcccccggggagauucuuuggagcgcuccucugggaccagauuugaaccccuacuuaucccaccugucucggauguauaauggcuacgccgguggguucgaaguucaggugauccuagcgggaaacgcauuuacagccggcaaagucauuuucgcugccgugccuccaaauuuuccgacugagggccucucgcccucacagguaacgauguucccucauaucauaguugacgugcgccaacuggagccaguccuuaucccccugccugaugugcgaaacaauuuuuaucacuacaaccagagccaugacaguaccuugaagcucauugcaaugcuguauacaccacugcgugcuaauaacgccggggaugacguguucacugucuccugcagaguucucaccaggcccucuccggauuuugacuucaucuuuuuagugccucccacaguagaaagccggaccaaaccauucacugugccuauucugacagucgaggaaauguccaacucacgcuuucccaucccacuugagaaguuguacaccggacccaguagcgcguucgugguucagccucagaaugguagauguacgacugauggcgugcugcuagggaccacacaacucucugccgucaacauaugcaauuucaggggagacgugacucacauuguaggcucccaugauuauaccaugaaccuggcaucacagaauuggagcaacuacgacccaacagaggaaaucccggcuccccuugguaccccugacuuuguugggaaaauucagggacugcggacgcagacuacacgcgccgauggcaguacccgagcucacaaggccacugugucuacaggcuccguccacuucaccccaaaguuggggagcgugcaauuuacgaccgacacaaauaacgauuuccagacuggacagaauaccaaauuuacacccgucggugugauccaagacggcgaucaucaccagaacgagccucagcaguggguucucccaaauuacucggggagaacuggacauaacgugcaccuggcacccgccguagcuccgaccuucccuggcgaacaauuacuguuuuucaggucuacaaugccagguuguuccggguaucccaauaugaaccucgacugccuucugccucaggagugggucuugcacuuuuaccaggaagcggcacccgcccagucagauguggcucuacugcgguucguuaauccagacaccggccgugugcucuuugaguguaagcugcauaaaaguggauauaucacugucgcccacacgggcccuuacgaucuugugauucccccaaacggguauuuccgcuuugacagcuggguaaaccaauucuacacacuggcaccgaugggaaaugguaccggcagaaggcgguga

SEQ ID NO: 21535 - RNA, 1614 nt, Artificial Sequence
  derived and/or modified sequence opt3 from VP1__Norovirus_and/or_Norovirus-like__LC016604
augaagauggccagcaacgacgcuucccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucacagugccuaucuuaaccgucgaggaaaugacgaauagccgcuuucccauaccacuggagaaacuuuucacuggacccuccucagcguucgugguucagccucagaacgguagauguaccacagauggcguguugcuggggacuacccaacuaaguccagucaauauuugcacauuuaggggagacgugacccauaucccgggcacgcggacuuaccgcaugaaccucgccagccagaauuggaacaauuaugaucccacagaggaaauuccugcaccacuggguacccccgacuucguagggaagauccagggaaugcuuacucagacaaccaagggcgacggcucuacgcgagggcacaaggcuaccguuuccacaggaucaguggauuuuacuccuaaacuggguagcguccaauucgacaccgauacaaacaaugacuuggagacuggccagaacaccagauuuacaccagugggggucauccaggauggaagugcccauaggaaugaaccccaacagugggugcucccggacuacucuggccggaccguucacaacgugcaccuggcuccugccguagcaccaacuuuccccggugagcaguuacuguuuuuccguuccacgaugccuggguguagcggcuaccccaauauggaucucgacugccuucugccacaggaauggguccaacauuuuuaucaggaggccgcuccugcgcagucggauguggcauugcuacgcuucguuaaccccgacacaggaagagugcuguuugaguguaagcuccacaaaaccggcuacgucacuguggcccauaccgggcagcacgaucugguaauuccaccgaauggauauuucagguuugacucuugggugaaccaauucuacacacuugcuccuauggguaacggcgccgggcggcgacgcuga

SEQ ID NO: 21536 - RNA, 1614 nt, Artificial Sequence
  derived and/or modified sequence opt3 from VP1__Norovirus_and/or_Norovirus-like__KF806532
augaagauggccagcaacgacgcuucccccucugauggcucagcagccaaucuggugccugaggucaacaaugaaguuauggcgcucgagccagugguaggggcugccaucgcagccccgguggcuggacagcaaaacgucaucgaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucguuguggacguccgccaacuggagccagugcuuauaccccugccugaugugcgaaacaauuuuuaucacuacaaccagucaaaggacccaaccaucaaauugauugcuaugcucuauacaccccugcgugccaauaacgcgggggaagaugucuucacuguuagcugcagagugcugaccaggccgaguccugacuuugauuucaucuuucucguacccccaacaguggagucccggucuaagccuuucaccguccccauuuuaacuguggaagagaugacaaacagccgcuuuccaaucccccuggagaaacuuuucaccggaccuuccucagccuucguugugcagccacagaaugguagauguacgacugacggcgucuugcuggggaccacacaacuaaguccggugaacauaugcacuuuuaggggagaucucacccauuucgcaggcacaagcgaauacgcuaugaaucuggccucucagaacuggaccaauuaugaccccacggaggaaauuccugcuccacuuggugcccccgauuuuguagggaagauccggggaguucugacucagacaacccgccgagacggcuccacuagaggccacagggcaacauugucaaccgggagcgcccauuucacgccuaagcucggaaguauucgguuuucuaccgacacaaacaaugauuucgaggcuggucagaacacuaaauuuaccccagugggcgucuuccaagacggggauaaucaccagaacgaaccccagcaaugggugcugccgaauuacuccggagcgacagcacacaacguccauuuagccccugcuguggccccagcauuucccggcgagcagcuccuguucuuucguagcacuaugccugguuguucgggguaccccaauaugaaccuugacugccuguugacccaggaguggguucagcacuucuaucaagaagccgcuccagcccagucugauguggcacuacugcgcuuuguaaauccugacacauccagaguccucuucgaguguaagcugcauaaaucaggcuacgugaccguugcgcacacuggacagcacgaucuugugauucccccaaacggcuauuucagguuugacaguugggucaaccaguucuacacgcuggcuccgauggggaauggaacaggucggcgacgcuga

SEQ ID NO: 21537 - RNA, 1614 nt, Artificial Sequence
  derived and/or modified sequence opt3 from VP1__Norovirus_and/or_Norovirus-like__FJ537138
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccugucucggauguauaauggcuacgccgguggguucgaagugcaggucauucuagcgggaaacgcauuuacagccggcaaagugaucuucgcugccguaccuccaaauuuuccgacugagggccucucgcccucacagguuacgauguucccucauauuaucguggacguccgccaacuggagccagugcuuauaccccugccugaugugcgaaacaauuuuuaucacuacaaccaggcacaugacagcaccuugaagcucaucgcuaugcuguauacaccacugcgugccaauaacgcgggggaugacgucuucacuguuaguugcagagugcucaccaggcccuccccggauuuugacuucaucuuuuuaguaccucccacaguggaaucucggaccaaaccauucacugucccuauccugacaguggaggaaaugagcaacucccgcuuucccauuccacuugagaaguuguacaccggacccucaagugccuucguugugcagccucagaaugguagauguacgacugauggcguccugcuagggaccacacaacucagcgcagugaacaucugcaauuucaggggagacguaacucggguuggcauaucucacgauuauaccaugaaccuggugucccagaauuggaacaauuacgacccaacagaggaaauuccggcuccccuugguaccccugacuuugucgggaaaauccagggacuguugacgcagacuacacgcgccgauggcucaacccgagcucauaaggccacugugagcacaggcaguguccacuucaccccaaagcucgggucugugcaauuuacgaccgacacaaacaaugauuuccagacuggacagaacaccaaauuuacacccguuggugugauucaagacggcgaucaccaucagaaugagccucagcaguggguacugccaaacuacuccgggacuagcggacacaauguccauuuagcacccgccguggcuccgaccuucccuggcgaacaacugcucuuuuucagaucgacaaugccagguuguucuggguaucccaacaugaaucuugacugccuguugccucaggaguggguucuacacuuuuaccaggaagcggcacccgcccaguccgauguggcucugcucagguucgucaacccagacaccggccgggugcuguuugaguguaaacuucacaagucaggauauaucacuguagcccauacgggcccuuacgaucuggugauucccccaaacggguauuuccguuuugacaguuggguuaaucaauucuacacauuggcaccgaugggaaacgguaccggccgcagaagguga

SEQ ID NO: 21538 - RNA, 1614 nt, Artificial Sequence
  derived and/or modified sequence opt3 from VP1__Norovirus_and/or_Norovirus-like__AY030098
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacauuauagaccccuggaucagaaauaacuucguccaggcuccugguggcgaauuuacagugaguccaaggaaugcacccggggagauucuuuggagcgccccucugggaccagauuugaaccccuacuuaucccaccugucucggauguauaauggcuacgcugguggguucgaaguucaggugauccuagccggaaacgcguuuacugcaggcaaagucauuuucgccgcugugccuccaaauuuuccgacggagggccucucgcccucacagguaaccauguucccucauaucauaguugacgugcgccaacuggagccaguccuuaucccccugccugaugugcgaaacaauuuuuaucacuacaaccagagccaugacaguacauugaagcucauugccaugcuguauacuccacugcgugcaaauaacgcuggggaugacguguucaccgucuccugcagaguucucacaaggcccucuccggauuuugacuucaucuuuuuagugccucccaccguagaaagccggacuaaaccauucacagugccuauucugaccgucgaggaaauguccaacucacgcuuucccaucccacuugagaaguuguacacgggacccaguagcgccuucgugguucagccucagaaugguagauguacuaccgauggcgugcugcuagggacaacucaacucucugcggucaacauaugcaauuucaggggagacgugacccacauuguaggcucccaugauuauacaaugaaccugguuucacagaauuggagcaacuacgacccaaccgaggaaaucccggcaccccuugguacgccugacuuuguggggaaaauucagggacuguugacucagacaacccgggccgauggcaguacucgcgcucacaaggccacagucucuaccggcuccgugcacuucacgccaaagcucgggagcguccaauuuaccacagacacuaauaacgauuuccagaccggacagaauacaaaauuuacucccguggguguuauccaagacggcgaucaucaccagaacgagccucagcagugggugcugccagacuacucggggcgaaccggacauaauguacacuuagcucccgccgucgcaccgacauucccuggcgaacaacugcucuuuuucagaucuaccaugccagguuguuccggguaucccaacaugaaucuugauugccuguugccucaggagugggugcuacacuuuuaccaggaagccgcucccgcgcagucagacguugcacugcucagguucgugaacccagauacuggccggguccuguuugaguguaaacuucauaagaguggauauaucacgguggcccacacaggcccuuacgaccugguaauucccccaaauggguauuuccguuuugauagcugggugaaccaauucuacaccuuggcuccgaugggaaacgguacuggccgcagaagguga

SEQ ID NO: 21539 - RNA, 1614 nt, Artificial Sequence
  derived and/or modified sequence opt3 from VP1__Norovirus_and/or_Norovirus-like__AY532130
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaauaucauagaccccuggaucagaaacaauuucguccaggcuccugguggcgaauuuacagugucaccaaggaacgcacccggggagauucuuuggagugccccucugggaccagauuugaaucccuacuuaagccaccuggcucggauguauaacggcuacgccgguggguucgaaguucaggugauccuagcgggaaaugcauccacugccggcaaaauuaucuuugcugccgucccuccaaacuucccgacggagggccucucucccucacaggugaccauguuuccucauauaaucguagacguucgccaacuggagccagugcuuauuccccugccugauguccgaaauaacuucuaucacuacaaucagucgaacgacagcacaaucaaguugauugcaaugcucuauacuccacugcgugcuaacaaugccggggaugacguguuuaccgugaguugcagaguccugacaaggcccuccccggauuucgacuuuaucuuccucguuccucccaccguggaaucucggauaaaaccauuuacuguaccuauuuuaacaguggaggaaaugagcaacucccgcuuccccaucccacuggagaaacuuuacaccggacccucaagugcguuugucgugcagccucagaaugguagauguacgacugauggcguuuugcuggggaccacacaacuaagcgccgugaacauuugcacuuucaggggagacgucacccauaucgcaggcucucacgauuauacaaugaaucucgcuucccagaacuggaauaacuacgacccaaccgaggaaaucccggcuccccuggguacgccugacuucguggggaagauucagggaaugcuuacucagacaacccgggaggauggcucaacucgcgcccauaaggccacaguaagcaccggcagugcacacuuuacgccaaagcuggggucuguucaauacaccacagacacuaauaacgauuuccagaccggacagaauacaaaauuuacucccgugggugucauacaagacggcaacaaucaccagaacgaaccucagcaguggguguugccauccuauagcgggcgaaccggacauaauguccaccucgcccccgcuguggcgccgacauucccuggcgagcaacuguuauuuuucagaucgaccaugccagguuguucuggguaccccaacaugaaccuggauugccuccuuccucaggaauggguucagcauuuuuaucaggaggcagcccccgcucaauccgacguggcccuguugagguucguaaauccagauacuggccggguccuauuugaguguaagcugcacaaaucaggauacgugacgguugcacacacaggcccucaugaccucgugauucccccaaacggguauuuccguuuugauaguugggucaaucaguucuacacccuggccccgaugcgcaacggagcugguagaaggcgguga

SEQ ID NO: 21540 - RNA, 1614 nt, Artificial Sequence
  derived and/or modified sequence opt3 from VP1__Norovirus_and/or_Norovirus-like__KX514286
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaacguuuccgaccgagggccucucucccucgcagguaacaauguucccucauaucauaguugacgugcgccaacuggagccaguccuuaucccccugccugaugugcgaaauaacuuuuaucacuacaaucagucaaacgacagcacuauuaaguugaucgcaaugcucuauaccccacugcgugcuaauaaccccggggaugacguguucacagucaguugcagaguucugaccaggccguccccugauuuugacuucauuuuucucgugcccccaacuguagaaucucggacaaaaccuuucagcgugcccaucuuaaccgucggagagaugacgaacucccgcuuuccaauaaaucuggaaagacuuuucacuggucccucaagugccaacgugguucagccucagaaugggagguguaccauugauggcgaguugcugggaacaacucaacuaagcucugugaacaucugcaccuuccggggcgacgucacacauauugguuccacccaccauuggacgaugaaucucgcgucaccaaacuggaauaacuacgauccgacugaggaaacacccgccccucuggggaccccagacuuugugggaaagauccacggcaugcuuacucagacaacccaggagaauggcagcacgcgcgcacaccgagcuaccguauauguugggagugccgacuucacacccaaacugggaaaggugcaguuugaaacugauaccgaggacgauuuggcuaucagacaaaacacaaaguucacuccugucggugugauucagucuuccgaccaucacagggaugaaccacagcaauggcggcuccccaauuacagcggcgccaacaccuuuaauguccaucuggcaccggccguggcuccuaacuucccaggggagcaguuacuguuuuuccguucgacacuccccggauguggcggucacccuaauauggaccuugauugccuguugccccaggaguggguucagcacuuuuaccaagaagcggcaccagcccagucugacguggcucuacugcgcuucguaaacccugauaccuccagaguccucuuugaguguaaacugcauaagucaggguaugugacuguugcccacacgggccaguacgaccuugugcugcccaguaacggauauuucagguuugauagcugggucaaucaguucuacacauuggcaccaaugggcaacgggaccggacggcgacgcuga

SEQ ID NO: 21541 - RNA, 1614 nt, Artificial Sequence
  derived and/or modified sequence opt3 from VP1__Norovirus_and/or_Norovirus-like__KX514202
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaacuuuuccgacggagggccucucucccucgcagguaaccauguucccucauaucauaguugacgugcgccaacuggagccaguccuuaucccccugccugaugugcgaaauaacuuuuaucacuacaaucagucaaacgacagcacaauuaaguugaucgcuaugcucuauacuccacugcgugccaauaaccccggggaugacguguucaccgucaguugcagaguucugacaaggccguccccugauuuugacuucauuuuucucgugcccccaaccguagaaucucggacuaaaccuuucagcgugcccaucuuaacagucggagagaugaccaacucccgcuuuccaauaaaucuggaaagacuuuucacgggucccucaagugcgaacgugguucagccucagaaugggagguguacuauugauggcgaguugcugggaaccacacaacuaagcucugugaacaucugcacuuuccggggcgacgucacccauauugguuccacacaccauuggaccaugaaucucgccucaccaaacuggaauaacuacgauccgacggaggaaacucccgcaccucuggggacaccagacuuugugggaaagauccacggcaugcuuacccagacuacacagggcagcgggaguacccgcgcucaccgagccacgguauauguuggaucugcugaguucacccccaaacuggguaaggugcaguuuaagacagaaacugaccaugauuugaccaucagacaaaauacaaaauucacuccugucggcgugauucaggaguccgaccaccauagggaugaaccacagcaauggcggcuccccaacuacagcggggccaauaccuuuaacguccaccuggcaccggccguggcuccuaauuucccaggagagcaguuacuguuuuuccguucgacacuccccggcuguggugggcacccuaacauggaccuugauugccuguugccccaggaguggguucagcauuuuuaccaagaagcggcaccagcccagucugacguggcucuacugcgcuucguaaauccugauaccuccagaguccucuuugaguguaagcugcacaaaucaggcuaugugacuguugcccauacgggacaguacgaccuugugcugcccaguaacggcuauuucagguuugauagcugggucaaccaguucuacacauuggcaccaauggggaauggaaccggucggcgacgcuga

SEQ ID NO: 21542 - RNA, 1614 nt, Artificial Sequence
  derived and/or modified sequence opt3 from VP1__Norovirus_and/or_Norovirus-like__DQ358208
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccugucccggauguauaacggcuacgccgguggguucgaagugcaggucauucuagcgggaaaugcauuuacagccggcaaagugaucuucgcugccguaccuccaaacuuuccgacugagggccucucucccucgcagguuacgauguucccucauauuaucguggacguccgccaacuggagccagugcuuauaccccugccugaugugcgaaauaacuuuuaucacuacaaucaggcaaacgacucaaccuugaagcucaucgcuaugcuguauacaccacugcgugccaacaaugcgggggaugacgucuucacuguuagcugcagagugcucaccaggcccaguccggauuuugacuucauuuuucuuguaccucccacaguggaaucccggaccaaaccauucacugucccugugcugacaguugaggaaaugucuaacagccgcuuucccaucccacuugagaaguuguacaccggacccuccucagccuucgugguccagccucagaaugguagauguacgacugauggcgugcugcuagggaccacacaacucagugcaguaaacauuugcaauuucaggggagacguuacucauaucgcuggcagccacgauuauaccaugaaccuggccucucagaauugguccaacuacgacccaacagaggaaauaccggcuccccuugguaccccugacuuuguggggaaaauucagggacuguugacgcagacuacacgggccgauggcucaacccgcgcacauaaggccacugucagcacaggcagugugcacuucaccccaaagcucgggucuguccaauuuacgaccgacacaaauaacgauuuccaggcuggacagaauacuaaauuuacccccguggguguuauccaagacggcgaucaccaucagaacgagccucagcaguggucccugccaaauuacagcgggcgaacaggacacaacgugcauuuagcgcccgcaguagccccgacuuucccuggcgaacaacugcucuuuuucagaucgaccaugccagguuguucuggguaucccaauaugaaccuugacugccuguugccucaggaguggguccuacacuuuuaccaggaagcugcccccgcacaguccgauguggcccugcucagguucguuaacccagacacaggccgggugcuguuugaguguaaguuacacaaaucaggauauauuaccgucgcucauacuggcccuuacgaucugguguugcccccaaauggguauuuccguuuugacaguuggguaaaccaauucuacacgcucgccccgaugggaaaugguacaggccgcagaagguga

SEQ ID NO: 21543 - RNA, 1614 nt, Artificial Sequence
  derived and/or modified sequence opt3 from VP1__Norovirus_and/or_Norovirus-like__AF414425
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacagcaucaccaaggaacgcccccggggagauccuuuggagugcuccucugggaccagauuugaaucccuacuuaagccaccuggcccggauguauaacggcuacgcggguggguucgaaguucaggugauucuagcaggaaaugccuuuacugcuggcaaaaucauuuucgccgcagucccuccaaacuuuccgacggagggccucucccccucucaggugaccauguucccucauaucauaguagacguucgccaacuggagccagugcuuaucccccugccugauguccgaaauaacuuuuaucacuacaaucagucgaacgacucaacaauuaaguugaucgcuaugcucuauacuccacugcgugccaacaaugcgggggaugacguguucaccgccagcugcagagugcugacaaggcccaguccggauuuugacuucauuuuucucgucccucccaccguugaaucccggacuaaaccauucacagugccuaucuuaaccguagaggaaaugucuaacagccgcuuucccauaccacuggagaaacuuuacacgggacccuccucagcauucgugguccagccucagagugguagauguacuaccgauggcguguugcuggggacaacucaacuaagcgcuguuaauauuugcaccuucaggggagacgugacacauaucgccggcucucacgauuauaccaugaaccucgcuucccagaauuggaacaauuacgacccaacggaggaaauuccggcaccccuggguacuccugacuuugucgggaagauccagggaaugcuuacacagaccacucgggaggauggcucaacacgcgcccauaaggccaccgugagcacgggcaguguacacuucaccccaaagcuggggucuguucaauacacaacugacaccaacaaugauuuucagacaggacagaacacuaaauucacccccgugggugucauccaagacggcaauaaccaccagaaugaaccucagcaguggguguugccaaacuauuccgggcgaacaggacauaauguccaccucgcucccgcgguggcaccgaccuuuccuggcgagcaacuguuauucuuuaagagcacuaugccagguuguucgggguaccccaacaugaaccuggauugccuccuuccucaggaauggguucagcauuucuaucaggaggccgcucccgcccaaucugacguggcacuguugagauuuguaaauccagauacgggcaggguccuauucgaguguaaacugcacaaguccggauacgugacaguugcccacaccggcccucaugaccucgugauucccccaaacggguauuuucgguucgauucaugggucaaucaguuuuacacucuggcuccgaugggaaacggugccggccgucgcagauga

SEQ ID NO: 21544 - RNA, 1614 nt, Artificial Sequence
  derived and/or modified sequence opt3 from VP1__Norovirus_and/or_Norovirus-like__KX514348
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaacuuuuccgacggagggccucucccccucucagguaaccauguucccucauaucauaguugacgugcgccaacuggagccaguccuuaucccccugccugaugugcgaaacaauuuuuaucacuacaaccagucgaaugacucaacaauuaaguugaucgcuaugcucuauacuccacugcgugccaacaaccccggggaugacguguucaccgucagcugcagaguucugacaaggccgaguccugauuuugacuucauuuuucucgugcccccaaccguagaaucccggacuaaaccuuucucugugcccaucuuaacagucggagagaugaccaauagccgcuuuccagugaaccuggaaagacuuuucacgggucccuccucagcgaauguugugcagccucagaacgggagguguacuauagauggggaguugcugggaaccacacaacuaaguagcgucaauauuugcacuuuccggggcgacgugacccagaucgguucuacaaagcauuggaccaugaaccucgccuccccaaauuggaacaauuacgauccgacggaggaaacucccgcaccucuggggacaccagacuuuguaggaaaaauucacggcaugcuuacccagacuacacaggagaacggcucaacccgcgcucaucgagccacgguuuaugugggcggagcuaauuucacccccaagcuggguaagguccaauuugaaacagacacuguggaugacuuggagaucagacagaacaccaaauucacaccugucggcgugauccagagcagugaucaccacagggacgaaccacaacaguggguucuccccucuuacuccgggcgggauacuccgaaugugcaucuggccccugcaguagccccaaacuuucccggagagcaguuacuguucuuucguagcacccucccuggcuguggugggcaccauaauauggaccuugauugccuguugccccaggaguggguccaacacuucuaccaggaagcugcgccagcacagucggacguggcccuacugcgcuuuguuaacccugauacaucuagaguccucuucgaguguaagcugcacaaauccggcuaugugaccguggcucauacuggacaguacgaccuuguacugcccucaaacggcuauuuuagguucgauaguugggugaaucaauuuuacacguuggccccaauggggaacggaacaggucggcgacgcuga

SEQ ID NO: 21545 - RNA, 1614 nt, Artificial Sequence
  derived and/or modified sequence opt3 from VP1__Norovirus_and/or_Norovirus-like__KX514287
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaacuuuuccgacggagggccucucucccucgcagguaaccauguucccucauaucauaguugacgugcgccaacuggagccaguccuuaucccccugccugaugugcgaaauaacuuuuaucacuacaaucagucaaacgacagcacaauuaaguugaucgcuaugcucuauacuccacugcgugccaauaaccccggggaugacguguucaccgucaguugcagaguucugacaaggccguccccugauuuugacuucauuuuucucgugcccccaaccguagaaucucggacuaaaccuuucagcgugcccaucuuaacagucggagagaugaccaacucccgcuuuccaauaaaucuggaaagacuuuucacgggucccucaagugcgaacgugguucagccucagaaugggagguguacuauugauggcgaguugcugggaaccacacaacuaagcucugugaacaucugcacuuuccggggcgacgucacccagauugguuccacacaucacuggaccaugaaucucgccucaccaaacuggaauaacuacgauccgacggaggaaacucccgcaccucuggggacaccagacuuugugggaaagauccauggcaugcuuacccagacuacacaggagaauggcagcacccgcgcucaccgagccacgguauauguugggagugcugacuucacccccaaacugggaaaggugcaauuugaaacagauacuggugacgauuuggccaucagacagaacaccaaguucacaccugucggcgugauucagucuuccgaccaccauagggaugagccacaacaguggcggcuccccaauuacagcggggcaaacacuuuuaauguccaccuggccccggcuguggcgccuaacuucccaggagaacaguuacuguuuuuccguucgacccuccccggcuguggugggcauccuaauauggaccuugauugccuguugccccaggaguggguucaacacuuuuaccaggaggcagccccagcucagucugacguggcccuacugcgcuucguaaacccugauacauccagaguccucuuugaauguaaacugcacaagucaggcuaugugaccguugcacauacuggacaguacgaccuugugcugcccaguaacggcuauuucagguuugauagcugggucaaucaauucuacacguuggccccaauggggaacggaacaggucggcgacgcuga

SEQ ID NO: 21546 - RNA, 1614 nt, Artificial Sequence
  derived and/or modified sequence opt3 from VP1__Norovirus_and/or_Norovirus-like__KX514183
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaacuuuuccgacggagggccucucucccucgcagguaaccauguucccucauaucauaguugacgugcgccaacuggagccaguccuuaucccccugccugaugugcgaaauaacuuuuaucacuacaaucagucaaacgacagcacaauuaaguugaucgcuaugcucuauacuccacugcgugccaauaaccccggggaugacguguucaccgucaguugcagaguucugacaaggccguccccugauuuugacuucauuuuucucgugcccccaaccguagaaucucggacuaaaccuuucagcgugcccaucuuaacagucggagagaugaccaacucccgcuuuccagugaaucuggaaagacuuuucacgggucccucaagugcgaacguugugcagccucagaaugggagguguacuauagauggcgaguugcugggaaccacacaacuaagcucugucaacauuugcacuuuccggggcgacgugacccauaucgguacaacccagcacuggacgaugaaucucgccuccccaaacuggaauaacuacgauccgacugaggaaacacccgcaccucuggggaccccagacuuuguaggaaagauucauggcaugcuuacucagacaacccagggcucagggagcacgcgcgcucaccgagccaccguuuaugugggaagugcugaguucacacccaaacuggguaaggucagauuugaaacugacaccgaggaugacuuggugaucaggcaaaauacaaaguucacuccugucggcgugauccagucuuccgaacaccaucgggaugagccacagcaauggcgucuccccaacuacagcggggccaauaccuuuaacguucaccuggcaccggccguggcuccuaauuucccaggagagcaguuacuguuuuuccgcucgacacuccccggcuguggugggcauccuaacauggaccuugauugccuguugccccaggaauggguacagcacuuuuaccaagaggcggcaccagcccagucugacgucgcucuacugagauucgugaauccugauaccuccaggguucucuuugaauguaaacugcacaagucaggcuaugugacugucgcccauacgggacaguacgaccuugugcugcccaguaacggcuauuuccgguuugauagcuggguaaaccaguucuacacauuggcaccaauggggaauggaaccggucgacgcagauga

SEQ ID NO: 21547 - RNA, 1614 nt, Artificial Sequence
  derived and/or modified sequence opt3 from VP1__Norovirus_and/or_Norovirus-like__KX514174
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaacuuuuccgacggagggccucucccccucucagguaaccauguucccucauaucauaguugacgugcgccaacuggagccaguccuuaucccccugccugaugugcgaaacaauuuuuaucacuacaaccagucgaaugacucaacaauuaaguugaucgcuaugcucuauacuccacugcgugccaacaaccccggggaugacguguucaccgucagcugcagaguucugacaaggccgaguccugauuuugacuucauuuuucucgugcccccaaccguagaaucccggacuaaaccuuucucugugcccaucuuaacagucggagagaugaccaauagccgcuuuccagugaaccuggaaagacuuuucacgggucccuccucagcgaauguugugcagccucagaacgggagguguacuauagauggcgaguugcugggaaccacacaacuaaguagcgucaauauuugcacuuuccggggcgacgugacccauaucgguacaacccagcacuggacgaugaaccucgccucuccaaauuggaacaauuacgauccgacugaggaaacacccgcaccucuggggaccccagacuuuguaggaaagauucauggcaugcuuacucagacaacccagggcuccgggucaacgcgcgcucaccgagccaccguuuaugugggaagcgcugaguucacacccaaacuggguaaggucagauuugaaacugacaccgaggaugacuuggugaucaggcaaaacacaaaguucacuccugucggcgugauccagaguucugaacaccaucgggaugagccacagcaauggcgucuccccaauuacuccggggccaacaccuuuaauguucaccuggcaccggccguggcuccuaacuucccaggagagcaguuacuguuuuuccgcagcacacuccccggcuguggugggcauccuaauauggaccuugauugccuguugccccaggaauggguacagcacuuuuaccaagaggcggcaccagcccagucggacgucgcucuacugagauucgugaacccugauaccucuaggguucucuuugaauguaaacugcacaaguccggcuaugugacugucgcccauacgggacagcacgaccuugugauucccccaaacggcuacuuccgguuugauucauggguaaaucaguucuauacacuggcaccgauggggaacggaaccggucgaaaacgcuga

SEQ ID NO: 21548 - RNA, 1614 nt, Artificial Sequence
  derived and/or modified sequence opt3 from VP1__Norovirus_and/or_Norovirus-like__KF429791
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccgggcagguaaccauguucccucauaucauaguugacgugcgccaacuggagccaguccuuaucccccugccugaugugcgaaacaauuuuuaucacuacaaccagucgaaugacccaacaauuaaguugguggcaaugcucuauacuccccugcgugcuaacaacgccggagaugacgucuucaccguuucaugcagagugcugacaaggccgagcccugauuuugacuucaucuuucucguacccccaaccauugaaaguaaaacuaaguccuucucugugccuaucuuaacaauagaggaaaugaccaauagccgguuucccauuccacuggagaaacuuuucacgggucccuccucaacuuuggucgugcagccucagaacggccgcuguaccacagaugggguucugcuaggaacuacccaacucaguccagugaauaucugcacauucagaggcgacgucacccagauuacgaacacucauagcuacgagaugaaucuggcggcccagaacuggaacucuuaugauccgacagaagagauccccgcaccucuugguaccccagacuuuguggggaagauccagggaguacugacucaaacaaccaaggaaaauggcuccacgagggcucacaaagccaccguuuacacaggcucaacuggguucacccccaaguugggacgggugcaguuugucacagacacugaucgcgaccucgagaccaaucaggauacaaaauucaccccugugggugucauucaagacggcgaugcucaucagaacgaaccacagcagugggugcugcccagcuacuuagggacuaauaaccacaauguucaccuggccccggcaguggccccuacguuuccaggagagcaacuccuuuucuuucgaaguacaaugcccggcuguucugguuauccuaacaugaaucuggacugcuugcuaccccaggaguggguacaguacuucuaucaggaagcugcgccagcacaauccgaugucgcccugcucagauuugugaacccugacaccgggaggguucuguucgaguguaaacuucauaagagcggcuacgugacugucgcucacaccggacggcaugaucuggugauacccccaaacggcuauuuucguuucgacucguggguaucuccguuuuacacauuggccccuauggggaauggaaccggucgcagaagguga

SEQ ID NO: 21549 - RNA, 1614 nt, Artificial Sequence
  derived and/or modified sequence opt3 from VP1__Norovirus_and/or_Norovirus-like__AF427115
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacucaacaauuaaguugaucgcaaugcucuauacuccacugcgugcuaacaaugccggggaugacguguucaccgucagcugcagaguucugacaaggcccaguccggauuuugacuucauuuuucucgugccucccaccguagaaucccggacuaaaccauucacaaucccuauauuaaccggagaggaaaugucuaacagccgcuuucccauuccacuggagaaacuuuacacgggucccuccucagcguucgugguccagccucagaauggcagauguacuaccgaugggguguugcugggaacaacucaacuaagugccguuaacaucugcaccuucaagggcaaugugauucauaucgcagguagccacgacuauacaaugaaccucgcuucucagaauuggaacaauuacgauccaaccgaggaaacgccggcuccccuggggacuccugacuuugucggaaagauccagggccuucugacacagaccacuagggaggacggcuccacacgggcccauaaggccaccgugucagcagggagcguacacuucacgccaaaauugggaaguguucaauacaccacagauacuaacaaugacuuucagaccggucagaacacaaaguucacucccgugggcgucauucaagaugggaauaaccaccagaaugaaccucagcagugggugcucccaaacuauucuggacgcgccggccauaacguccaccuggcucccgcgguggcaccgaccuuuccuggugagcaauuacuguucuuucgauccacaaugccaggguguagcggcuaccccaauaugaaccucgacugccuucugccucaggaauggguucagcauuucuaucaggaggccgcucccgcccaaucggauguggcauugcuaagauuuguaaauccagacaccggaaggguccuguucgaguguaaacuccacaagucuggcuacgugacuguugcccacacggggccucaugaucuggugauacccccaaacggauauuuucgguucgacuccugggucaaucaguuuuacacacuugcuccgauggguaacggcgccgggcgucgcagauga

SEQ ID NO: 21550 - RNA, 1614 nt, Artificial Sequence
  derived and/or modified sequence opt3 from VP1__Norovirus_and/or_Norovirus-like__KX514314
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacucaacaauuaaguugaucgcaaugcucuauacuccacugcgugcuaacaaucccggggaugacguguucaccgucagcugcagaguucugacaaggccgaguccugauuuugacuucauuuuucucgugcccccaaccguagaaucccggacuaaaccuuucucugugcccaucuuaacagucggagagaugaccaacagccgcuuuccaauaaaucuggaaagacuuuucacgggucccuccucagccaacgugguucagccucagaaugggagguguacuauugauggcgaguugcugggaaccacacaacuaaguagcgugaacaucugcacuuuccggggcgacgucacccagauugguucuacaaagcauuggaccaugaaucucgcguccccaaacuggaauaacuacgauccgacggaggaaacucccgccccucuggggacaccagacuuugugggaaaaauccacggcaugcuuacccagacuacacaggagaauggcucaacccgcgcacaucgagcuacgguauauguugggggagccaacuucacccccaagcuggguaaggugcaauuugaaacagacacuggcgaugacuuggcuaucagacagaauaccaaauucacaccugucggggugauucagagcagugaucaccacagggacgagccacaacaguggcggcuccccaacuacucuggagccaauacuuuuaacguccaucuggcaccggccguggcuccuaacuucccaggcgaacaguuacuguuuuuccguuccacccuccccgguugugggggccacccuaauauggaucuugacugccuguugccccaggaguggguucaacauuuuuaccaggaggcggcaccagcccagagcgauguggcucuacugcgcuucguaaacccugacacaucgagaguccucuuugaauguaagcugcacaaaucuggauaugugaccguugcccacacuggccaguacgaucuugugcugcccuccaauggguauuucagguuugacucaugggucaaccaauucuacacguuggcaccaaugggaaaugguacaggccggcgacgcuga

SEQ ID NO: 21551 - RNA, 1614 nt, Artificial Sequence
  derived and/or modified sequence opt3 from VP1__Norovirus_and/or_Norovirus-like__KX514208
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaacuuuuccgacggagggccucucucccucgcagguaaccauguucccucauaucauaguugacgugcgccaacuggagccaguccuuaucccccugccugaugugcgaaauaacuuuuaucacuacaaucagucaaacgacagcacaauuaaguugaucgcuaugcucuauacuccacugcgugccaauaaccccggggaugacguguucaccgucaguugcagaguucugacaaggccguccccugauuuugacuucauuuuucucgugcccccaaccguagaaucucggacuaaaccuuucagcgugcccaucuuaacagucggagagaugaccaacucccgcuuuccaauaaaucuggaaagacuuuucacgggucccucaagugcgaacgugguucagccucagaaugggagguguacuauugauggcgaguugcugggaaccacacaacuaagcucugugaacaucugcacuuuccggggcgacgucacccauauugguuccacacaccauuggaccaugaaucucgccucaccaaacuggaauaacuacgauccgacggaggaaacucccgcaccucuggggacaccagacuuugugggaaagauccacggcaugcuuacccagacuacacagggcagcgggaguacccgcgcucaccgagccacgguauauguuggaucugcugaguucacccccaaacuggguaaggugcaguuuaagacagaaacugaccaugauuuguccaucagacaaaauaccaaauucacaccugucggcgugauucaggagagcgaccaccauagggaugaaccacagcaauggcggcuccccaacuacucgggggccaauacuuuuaacguccaccuggcaccggccguggcuccuaauuucccaggagagcaguuacuguuuuuccguucuacccuccccggcuguggugggcacccuaacaugaaucuugacugccuguugccccaggaguggguucagcauuuuuaccaagaagcggcaccagcccaguccgauguggcucuacugcgcuucguaaacccugacacaucaagaguccucuuugaguguaagcugcacaaaaguggcuaugugaccguugcccauacuggacaguacgaucuugugcugcccagcaacggcuauuucagguuugacuccugggucaaucaguucuacacguuggcaccaauggggaacggaacaggucggcgacgcuga

SEQ ID NO: 21552 - RNA, 1614 nt, Artificial Sequence
  derived and/or modified sequence opt3 from VP1__Norovirus_and/or_Norovirus-like__KX514206
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaacuuuuccgacggagggccucucucccucgcagguaaccauguucccucauaucauaguugacgugcgccaacuggagccaguccuuaucccccugccugaugugcgaaauaacuuuuaucacuacaaucagucaaacgacagcacaauuaaguugaucgcuaugcucuauacuccacugcgugccaauaaccccggggaugacguguucaccgucaguugcagaguucugacaaggccguccccugauuuugacuucauuuuucucgugcccccaaccguagaaucucggacuaaaccuuucagcgugcccaucuuaacagucggagagaugaccaacucccgcuuuccaauaaaucuggaaagacuuuucacgggucccucaagugcgaacgugguucagccucagaaugggagguguacuauugauggcgaguugcugggaaccacacaacuaagcucugugaacaucugcacuuuccggggcgacgucacccauauugguuccacacaccauuggaccaugaaucucgccucaccaaacuggaauaacuacgauccgacggaggaaacucccgcaccucuggggacaccagacuuugugggaaagauccacggcaugcuuacccagacuacacagggcagcgggaguacccgcgcucaccgagccacgguauauguuggaucugcugaguucacccccaaacuggguaaggugcaguuuaagacagaaacugaccaugauuuguccaucagacaaaauaccaaauucacaccugucggcgugauucaggagagcgaccaccauagggaugaaccacagcaauggcggcuccccaacuacucgggggccaauacuuuuaacguccaccuggcaccggccguggcuccuaauuucccaggagagcaguuacuguuuuuccguucuacccuccccggcuguggugggcacccuaacauggaccuugauugccuguugccccaggaguggguucagcauuuuuaccaagaagcggcaccagcccaguccgacguggcucuacugcgcuucguaaauccugauacaucaagaguccucuuugaguguaagcugcacaaaaguggcuaugugaccguugcccauacuggacaguacgaccuugugcugcccagcaacggcuauuucagguuugauuccugggucaaccaguucuacacguuggcaccaauggggaauggaacaggucggcgacgcuga

SEQ ID NO: 21553 - RNA, 1614 nt, Artificial Sequence
  derived and/or modified sequence opt3 from VP1__Norovirus_and/or_Norovirus-like__KX514198
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaacuuuuccgacggagggccucucucccucgcagguaaccauguucccucauaucauaguugacgugcgccaacuggagccaguccuuaucccccugccugaugugcgaaauaacuuuuaucacuacaaucagucaaacgacagcacaauuaaguugaucgcuaugcucuauacuccacugcgugccaauaaccccggggaugacguguucaccgucaguugcagaguucugacaaggccguccccugauuuugacuucauuuuucucgugcccccaaccguagaaucucggacuaaaccuuucagcgugcccaucuuaacagucggagagaugaccaacucccgcuuuccaauaaaucuggaaagacuuuucacgggucccucaagugcgaacgugguucagccucagaaugggagguguacuauugauggcgaguugcugggaaccacacaacuaagcucugugaacaucugcacuuuccggggcgacgucacccauauugguuccacacaccauuggaccaugaaucucgccucaccaaacuggaauaacuacgauccgacggaggaaacucccgcaccucuggggacaccagacuuugugggaaagauccacggcaugcuuacccagacuacacagggcagcgggaguacccgcgcucaccgagccacgguauauguuggaucugcugaguucacccccaaacuggguaaggugcaguuuaagacagaaacugaccaugauuugaccacaagacaaaauacuaaauucaccccugucggcgugauccaggaguccgaccaccauagggaugaaccacagcaauggcggcuccccaacuacagcggggccaauacauuuaacguccaccuggcaccggccguggcuccuaauuucccaggagagcaguuacuguuuuuccguucgacccuccccggcuguggugggcacccuaacauggaccuugauugccuguugccccaggaguggguucagcauuuuuaccaagaagcggcaccagcccagucugacguggcucuacugcgcuucguaaauccugauacuuccagaguccucuuugaguguaagcugcacaaaucaggcuaugugacgguugcccauacaggacaguacgaccuugugcugcccaguaacggcuauuucagguuugauagcugggucaaccaguucuacaccuuggcaccaauggggaauggaacuggucggcgacgcuga

SEQ ID NO: 21554 - RNA, 1614 nt, Artificial Sequence
  derived and/or modified sequence opt3 from VP1__Norovirus_and/or_Norovirus-like__KX514191
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaacuuuuccgacggagggccucucucccucgcagguaaccauguucccucauaucauaguugacgugcgccaacuggagccaguccuuaucccccugccugaugugcgaaauaacuuuuaucacuacaaucagucaaacgacagcacaauuaaguugaucgcuaugcucuauacuccacugcgugccaauaaccccggggaugacguguucaccgucaguugcagaguucugacaaggccguccccugauuuugacuucauuuuucucgugcccccaaccguagaaucucggacuaaaccuuucagcgugcccaucuuaacagucggagagaugaccaacucccgcuuuccagugaaucuggaaagacuuuucacgggucccucaagugcgaacguugugcagccucagaaugggagguguacuauagauggcgaguugcugggaaccacacaacuaagcucugucaacauuugcacuuuccggggcgacgugacccauaucgguacaacccgccacuggacgaugaaucucgccuccccaaacuggaauaacuacgauccgacugaggaaacacccgcaccucuggggaccccagacuuuguaggaaagauucauggcaugcuuacucagacaacccagggcucagggagcacgcgagcucacagagccaccguuuaugugggaagugcugaguucacacccaaacuggguaaggucagguuugaaacugacaccgaggaugacuuggugauccggcagaauacaaaguucacuccugucggcgugauccaaucuuccgaacaccaucgugaugagccacagcaguggcgccuccccaacuacagcggggccaauaccuuuaacguucaccuggcaccggccguggcuccuaauuucccaggagagcaauuacuguuuuucagaucgacacuccccggcuguggugggcauccuaacauggaccuugauugccuguugccccaggaauggguacagcacuuuuaccaggaggcggcaccagcccaaucugacgucgcucuacugagguucgugaauccugauaccucccggguucucuuugaauguaaacugcacaagucaggcuaugugacugucgcccauacgggacaguacgaccuugugcugcccaguaacggcuauuuccgauuugauagcuggguaaaccaguucuacacauuggcaccaauggggaauggaaccggucgcagaagguga

SEQ ID NO: 21555 - RNA, 1614 nt, Artificial Sequence
  derived and/or modified sequence opt3 from VP1__Norovirus_and/or_Norovirus-like__KX514187
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaacuuuuccgacggagggccucucucccucgcagguaaccauguucccucauaucauaguugacgugcgccaacuggagccaguccuuaucccccugccugaugugcgaaauaacuuuuaucacuacaaucagucaaacgacagcacaauuaaguugaucgcuaugcucuauacuccacugcgugccaauaaccccggggaugacguguucaccgucaguugcagaguucugacaaggccguccccugauuuugacuucauuuuucucgugcccccaaccguagaaucucggacuaaaccuuucagcgugcccaucuuaacagucggagagaugaccaacucccgcuuuccagugaaucuggaaagacuuuucacgggucccucaagugcgaacguugugcagccucagaaugggagguguacuauagauggcgaguugcugggaaccacacaacuaagcucugucaacauuugcacuuuccggggcgacgugacccauaucgguacaacccgccacuggacgaugaaucucguauccccaaacuggaauaacuacgauccgacugaggaaacacccgccccucuggggaccccagacuuuguuggaaagauucauggcaugcuuacucagacaacccagggcucagggagcacgcgagcacacagagcuaccguguaugucggaagugccgaguucacacccaaacuggguaaggugagguuugaaacugacaccgaggaugacuuggucauccggcagaauacaaaguucacuccugugggcguuauccaaucuuccgaacaccaucgugaugagccacagcaguggcgccuccccaacuacagcggggcuaauaccuuuaacgugcaccuggccccggcaguagccccuaauuucccaggagagcaauuacuguuuuucagaucgacacuccccggcuguggugggcauccuaacauggaccuugauugccuguugccccaggaauggguccagcacuuuuaccaggaggcugcgccagcacaaucugacguggcccuacugagguucguuaauccugauaccucccgggugcucuuugaauguaaacugcacaagucaggcuaugucacuguggcucauacgggacaguacgaccuuguacugcccaguaacggcuauuuccgauuugauagcugggugaaccaguucuacacauuggccccaauggggaauggaaccggucgcagaagguga

SEQ ID NO: 21556 - RNA, 1614 nt, Artificial Sequence
  derived and/or modified sequence opt3 from VP1__Norovirus_and/or_Norovirus-like__KX514180
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucauccaggcaccugguggcgaauuuaccgugaguccaaggaaugcccccggggagauucuuuggagcgcuccucugggaccagauuugaaccccuacuuaucccaccuggcccggauguauaauggcuacgcggguggguucgaaguucaggugauccuagcaggaaacgccuuuacagcuggcaaaauuaucuucgccgcagucccuccaacuuuuccgacggagggccucucucccucacaggugaccauguucccucauauaaucguagacguucgccaacuggagccagugcuuauuccccugccugauguccgaaauaacuuuuaucacuacaaucagucgaacgacagcacaaucaaguugauugcuaugcucuauacuccacugcgugccaauaaccccggggaugacguguucaccgugaguugcagaguccugacaaggccguccccugauuuugacuucaucuuucucguucccccaaccguggaaucucggacuaaaccuuucagcguacccauauuaacagugggagagaugaccaacucccgcuuuccaauuaaucuggaaagacuuuucacgggucccucaagugcgaacgucgugcagccucagaaugggagguguacuaucgauggcgaguugcugggaaccacacaacuaagcucuguuaacauuugcacuuuccggggcgacgugacccagaucgguuccacacagcauuggaccaugaaucucgccucaccaaacuggaauaacuacgauccgacggaggaaacucccgcaccucuggggacaccagacuuugucggaaagauccacggcaugcuuacccagacuacacaagagaauggcagcacccgcgcucaucgagccacgguguauguagggagugcuaacuucacccccaaacugggaaagguucaguuugaaacagacacuggugaugacuuggccauuagacagaauaccaaguucacaccugugggcgucauacaaucuuccgaucaccacagggacgagccacagcaguggcggcuccccaacuacagcggggcaaauacuuuuaacgugcaucuggccccggcugucgcgccuaauuucccaggagaacaguuacuguuuuuccguucgacccuccccggcuguggugggcacccuaacauggaucuugacugccuguugccccaagagugggugcagcauuuuuaccaggaggcagccccagcucagucugauguugcccuacugcgcuucgugaacccugacacauccagaguacucuuugaauguaaacugcacaagucaggcuaugucaccguggcacacacuggacaauacgaucuuguucugcccaguaauggcuauuucagguuugacagcugggugaaccaguucuacacguuggccccaauggggaauggaacaggucggcgacgcuga

SEQ ID NO: 21557 - RNA, 1614 nt, Artificial Sequence
  derived and/or modified sequence opt3 from VP1__Norovirus_and/or_Norovirus-like__GU598213
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugacucauggauaagaaacaauuucgugcaggcucccgguggcgaauuuacaguuaguccuaggaacgcaccaggggagauccuuuggagcgcaccccugggaccugauuugaauccauacuuaucccaccuggcucggauguauaacggcuacgccgguggguucgaagugcaggucauucuagcgggaaaugcauuuacugccggcaaaaucauuuucgcugccgugcccccuaacuuuccaacggagggccucucuccgucgcagguaaccauguucccccauaucauaguugacgugcgccaacuggagccuguccuuaucccacugcccgaugugcgaaauaacuuuuaucacuacaaucagucaaacgacagcacaauuaaguugaucgcaaugcucuauacuccucugcgugcuaacaaugccggggaugacguguucaccgucaguugcagaguucugacaaggccaucccccgauuuugacuucauuuuucucgugccgccuaccguagaaucucggacuaaacccuucacagugccaaucuuaaccgucgaggaaaugagcaacucccgcuuuccuauaccccuggagaaacuuuacacgggaccaucaagugcguucgugguucagccccagaaugguagauguacuaccgauggcguguugcuggggacaacucaacuaagcgccgucaacauuugcaccuucaggggagacgugacacauaucgcaggcucucacgauuauaccaugaaucucgcuucccagaacuggucaaauuacgacccuacggaggaaauuccagccccgcuggguacucccgacuuuguagggaagauccagggaaugcuuacacagaccacucgggaggauggcagcacacgcgcucauaaggccaccguuaguacgggcucugugcacuucaccccuaagcugggguccguccaauacacaacugacaccaacaaugauuuucagacaggacagaacacuaaauucaccccagugggugucauccaagacggcaauaaccaccagaaugaaccccagcaguggguguugccuaacuauagcgggcgaacaggacauaauguucaccucgcaccagccguggcucccaccuuuccgggcgagcaacuguuauucuuuagaucgacuaugccugguuguucuggguacccaaacaugaaccuggauugccuccuuccccaggaauggguacagcauuucugucaggaggcggccccugcccaauccgacgucgcucuguugagguuugugaaucccgauacgggccggguucuauucgagugcaagcugcacaaaucaggauaugugacagucgcccacaccggcccacaugaccucgugauuccucccaacggguacuuucguuucgauaguuggguaaaucaguuuuauacucuggcaccaaugggaaacggugccggccgcagaagguga

SEQ ID NO: 21558 - RNA, 1614 nt, Artificial Sequence
  derived and/or modified sequence opt3 from VP1__Norovirus_and/or_Norovirus-like__KX514365
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaacguuuccgaccgagggccucucucccucgcagguaacaauguucccucauaucauaguugacgugcgccaacuggagccaguccuuaucccccugccugaugugcgaaauaacuuuuaucacuacaaucagucaaacgacagcacuauuaaguugaucgcaaugcucuauaccccacugcgugcuaauaaccccggggaugacguguucacagucaguugcagaguucugaccaggccguccccugauuuugacuucauuuuucucgugcccccaacuguagaaucucggacaaaaccuuucagcgugcccaucuuaaccgucggagagaugacgaacucccgcuuuccaauaaaucuggaaagacuuuucacuggucccucaagugccaacgugguucagccucagaaugggagguguaccauugauggcgaguugcugggaacaacucaacuaagcucugugaacaucugcaccuuccggggcgacgucacacagauucgcuccacccagcauuggacgaugaaucucgcgucaccaaacuggaauaacuacgauccgacugaggaaacacccgccccucuggguaccccagacuuuguggggaagauccacggaaugcuuacucagacaacccaagagaauggcagcacgcgagcacauagagcuaccguauauguuggcagugccaacuucacacccaaacuggggaaggugcaguuugaaacugacaccggagaugacuuggcuaucaggcagaauacaaaguucacuccugucggugugauucaaucuuccgaucaccaccgggacgagccacagcaguggcgucuccccaacuacagcggcgccaauaccuuuaacguccaucuggcaccggccguggcuccuaauuucccaggggaacaguuacuguuuuuccgcucgacacuccccggauguggcggucacccuaacauggaucuugacugccuguugccccaagaguggguucagcauuuuuaccaggaggcggcaccagcccagucugauguggcucuacugagauucguaaacccugacaccuccaggguccucuuugaauguaaacugcacaagucaggguaugugacuguugcccacacgggccaauacgaucuugugcugcccaguaauggauauuuccgguuugacagcugggucaaccaguucuacacauuggcaccaaugggcaaugggaccggacgacgcagauga

SEQ ID NO: 21559 - RNA, 1614 nt, Artificial Sequence
  derived and/or modified sequence opt3 from VP1__Norovirus_and/or_Norovirus-like__KX514304
augaagauggugagcaacgacgccaaucccuccgauggcucugcugcaaaccuggucccugagguuaauaacgaagugauggcccucgagccaguagugggggcggcuaucgccgcaccggucgccggacagcaaaaugugauugaccccuggauaagaaacaauuucguucaggcuccugguggcgaauuuaccgugucaccaaggaacgcacccggggagauccuuuggagugccccucugggaccagauuugaaucccuacuuaagccaccuggcucggauguauaacggcuacgccgguggguucgaaguccaggugauucuagcgggaaaugcauuuacagccggcaaaaucauuuucgcugccguaccuccaacuuuuccgacggagggccucucccccucucagguuaccauguucccucauaucauaguggacguccgccaacuggagccagugcuuaucccccugccugaugugcgaaacaauuuuuaucacuacaaccagucgaaugacucaacaauuaaguugaucgcaaugcucuauacuccacugcgugcuaacaaccccggggaugacgucuucaccguuagcugcagagugcugacaaggccgaguccugauuuugacuucauuuuucucguacccccaaccguggaaucccggacuaaaccuuucucuguccccaucuuaacagugggagagaugaccaauagccgcuuuccaauaaaccuggaaagacuuuucacgggucccuccucagccaauguugugcagccucagaacgggagguguacuauugauggggaguugcugggaaccacacaacuaaguagcgucaauaucugcacuuuccggggcgacgugacccagauugguucuacaaagcauuggaccaugaaccucgcguccccaaauuggaacaauuacgauccgacggaggaaacucccgccccucuggggacaccagacuuuguaggaaaaauccacggcaugcuuacccagacuacacaggagaacggcucaacccgcgcacaucgagcuacgguuuaugugggcggagccaauuucacccccaagcuggguaagguccaauuugaaacagacacuggcgaugacuuggcuaucagacagaacaccaaauucacaccugugggggucauucagagcagugaucaccacagggacgagccacaacaguggcggcuccccaauuacucuggagccaacacuuuuaaugugcaucuggcaccggccguugcuccuaacuucccaggcgaacaguuacuguuuuuccguuccacccuccccgguugugggggccacccuaacauggaucuugacugccuguugccccaggagugggugcaacauuuuuaccaggaggcggcaccagcccagagcgauguagcucuacugcgcuucgucaauccugacacaucgagagugcucuuugaauguaagcugcacaaaucuggauauguuaccguggcccacacuggccaguacgaucuuguccugcccuccaacggguauuucagguuugacucaugggugaaucaauucuacacguuggcaccaaugggaaacgguacaggccggcgacgcuga

SEQ ID NO: 21560 - RNA, 1614 nt, Artificial Sequence
  derived and/or modified sequence opt3 from VP1__Norovirus_and/or_Norovirus-like__KX514302
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaacuuuuccgacggagggccucucucccucgcagguaaccauguucccucauaucauaguugacgugcgccaacuggagccaguccuuaucccccugccugaugugcgaaauaacuuuuaucacuacaaucagucaaacgacagcacaauuaaguugaucgcuaugcucuauacuccacugcgugccaauaaccccggggaugacguguucaccgucaguugcagaguucugacaaggccguccccugauuuugacuucauuuuucucgugcccccaaccguagaaucucggacuaaaccuuucagcgugcccaucuuaacagucggagagaugaccaacucccgcuuuccaauaaaucuggaaagacuuuucacgggucccucaagugcgaacgugguucagccucagaaugggagguguacuauugauggcgaguugcugggaaccacacaacuaagcucugugaacaucugcacuuuccggggcgacgucacccagauugguuccacacagcauuggaccaugaaucucgccucaccaaacuggaauaacuacgauccgacggaggaaacucccgcaccucuggggacaccagacuuugugggaaagauccacggcaugcuuacccagacuacacaagagaauggcagcacccgcgcucaucgagccacgguauauguugggggagcuaacuucacccccaaacuggguagagugcaguuugaaacagacacuaccgaugacuuggaugcccaccagaauacaaaguucacuccugucggcgugauccaaaguucugaccaccauagggaugagccacagcaguggcggcuccccaacuacuccggggcaaauaccuuuaacguccaccuggccccggcuguggcgccuaauuucccaggagaacaguuacuguuuuuccguagcacacuccccggcuguggugggcauccuaacauggaccuugauugccuguugccccaagaguggguucagcacuuuuaccaggaggcagccccagcucagucggacguggcccuacugcgcuucguaaacccugauaccucuagaguccucuuugaauguaagcugcacaaauccggcuaugugacuguugcacauacgggacaauacgaccuugugcugcccucaaauggcuauuucagguuugauaguugggucaaccaguucuacacauuggccccaauggggaauggaaccggucggcgacgcuga

SEQ ID NO: 21561 - RNA, 1614 nt, Artificial Sequence
  derived and/or modified sequence opt3 from VP1__Norovirus_and/or_Norovirus-like__KX514207
augaagauggccagcuccgacgcuaaccccucugauggcucagcagccaaucuggugccugaggucaacaaugaaguuauggcgcucgagccagugguaggggcugccaucaccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaacguuuccgaccgagggccucucucccucgcagguaacaauguucccucauaucauaguugacgugcgccaacuggagccaguccuuaucccccugccugaugugcgaaauaacuuuuaucacuacaaucagucaaacgacagcacuauuaaguugaucgcaaugcucuauaccccacugcgugcuaauaaccccggggaugacguguucacagucaguugcagaguucugaccaggccguccccugauuuugacuucauuuuucucgugcccccaacuguagaaucucggacaaaaccuuucagcgugcccaucuuaaccgucggagagaugacgaacucccgcuuuccaauaaaucuggaaagacuuuucacuggucccucaagugccaacgugguucagccucagaaugggagguguaccauugauggcgaguugcugggaacaacucaacuaagcucugugaacaucugcaccuuccggggcgacgucacacauauugguuccacccaccauuggacgaugaaucucgugucaccaaacuggaauaacuacgauccgacugaggaaacacccgcgccucuggggaccccagacuuuguaggaaagauccacggcaugcuuacucagacaacccagggcagcgggaguacgcgcgcccaccgagcaaccguuuaugugggaucugcugaguucacacccaaacuggguaagguccaguuuaagacugaaaccgaccaugauuuguccaucagacaaaauacaaaauucacuccugugggcgucauucaggagagcgaccaccauagggaugaaccacagcaauggcggcuccccaacuacucgggggccaaugcuuuuaacgugcaccuggccccggcaguugccccuaauuucccaggagagcaguuacuguuuuuccguucuacccuccccggcuguggugggcacccuaacauggaccuugauugccuguugccccaggagugggugcagcauuuuuaccaagaagcugcgccagcacaguccgacguagcccuacugcgcuucgucaauccugauacaucaagagugcucuuugaguguaagcugcacaaaaguggcuauguuaccguggcucauacuggacaguacgaccuuguccugcccagcaacggcuauuucagguuugauuccugggugaaccaguucuacacguuggccccaauggggaauggaacaggucggcgacgcuga

SEQ ID NO: 21562 - RNA, 1614 nt, Artificial Sequence
  derived and/or modified sequence opt3 from VP1__Norovirus_and/or_Norovirus-like__KX514192
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaacuuuuccgacggagggccucucucccucgcagguaaccauguucccucauaucauaguugacgugcgccaacuggagccaguccuuaucccccugccugaugugcgaaauaacuuuuaucacuacaaucagucaaacgacagcacaauuaaguugaucgcuaugcucuauacuccacugcgugccaauaaccccggggaugacguguucaccgucaguugcagaguucugacaaggccguccccugauuuugacuucauuuuucucgugcccccaaccguagaaucucggacuaaaccuuucagcgugcccaucuuaacagucggagagaugaccaacucccgcuuuccagugaaucuggaaagacuuuucacgggucccucaagugcgaacguugugcagccucagaaugggagguguacuauagauggcgaguugcugggaaccacacaacuaagcucugucaacauuugcacuuuccggggcgacgugacccauaucggugccacacgccacuggaccaugaaucucgcauccccaaacuggaauaacuacgauccgacggaggaaacucccgcuccucuggggacaccagacuuuguaggaaagauucauggcaugcuuacccagacuacacagggcucagggagcacccgagcccacagagcuacgguuuaugugggaagugccgaguucacccccaaacuggguaaggucagguuugaaacagacacugaggaugacuuggugauccggcagaauaccaaguucacaccugucggcgugauccaaucuuccgaacaccaucgugaugagccacagcaguggcgccuccccaacuacagcggggcaaauacuuuuaacguucaccuggccccggcuguggcgccuaauuucccaggagagcaauuacuguuuuucagaucgacccuccccggcuguggugggcauccuaacauggaccuugauugccuguugccccaggaauggguacagcacuuuuaccaggaggcagccccagcucaaucugacgucgcccuacugagguucgugaauccugauacaucccggguucucuuugaauguaaacugcacaagucaggcuaugugaccgucgcacauacuggacaguacgaccuugugcugcccaguaacggcuauuuccgauuugauagcuggguaaaccaguucuacacguuggccccaauggggaauggaacaggucgcagaagguga

SEQ ID NO: 21563 - RNA, 1614 nt, Artificial Sequence
  derived and/or modified sequence opt3 from VP1__Norovirus_and/or_Norovirus-like__KF806525
augaagauggccagcaacgacgcuucccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucguuguggacguccgccaacuggagccagugcuuauaccccugccugaugugcgaaacaauuuuuaucacuacaaccagucaaaggacccaaccaucaaauugauugcuaugcucuauacaccccugcgugccaauaacgcgggggaagaugucuucacuguuagcugcagagugcugaccaggccgaguccugacuuugauuucaucuuucucguacccccaacaguggagucccggucuaagccuuucaccguccccauuuuaacuguggaagagaugacauacagccgcuuuccaaucccccuggagaaacuuuucaccggaccuuccucagccuucguugugcagccacagaacgguagauguacgacugacggcgucuugcuggggaccacacaacuaaguccggugaauauaugcacuuuuaggggagaucucacccauuucgcaggcacaagcgaauaugcuaugaaccuggccucucagaauuggaccaacuacgaccccacggaggaaauuccugcuccacuuggugcccccgauuuuguagggaagauccggggaguucugacucagacaacccgcggcgacggcuccacucgagggcacagagcaacauugucaaccggaagcgcccauuucacgccuaagcucgguagugugagguuuucuaccgacacaaauaacgauuucgaggcuggccagaauacuaaauuuaccccagucgggguguuccaagacggagauaaccaccagaaugaaccccagcaauggguccugccgaacuacuccggcgcgacagcacacaaugugcauuuagccccugcuguugccccagcauuucccggugagcagcuccucuucuuucggagcacuaugccuggguguucgggcuaucccaacaugaaucuugacugccuguugccacaggagugggugcagcacuucuaccaagaagccgcuccugcccagucugauguagcacuacugcguuuugucaaccccgacaccucccgcgugcuguucgaguguaagcugcauaaaucaggauauguuacaguggcgcacaccggccagcacgaucuugucauuccaccgaauggguacuucagauuugacaguugggugaaccaguucuauacucuggcuccuaugggaaacgguacgggcaggcggcgauga

SEQ ID NO: 21564 - RNA, 1614 nt, Artificial Sequence
  derived and/or modified sequence opt3 from VP1__Norovirus_and/or_Norovirus-like__KC462195
augaagauggccagcaacgacaccauccccuccgauggcucuacagcuaaucuggugccugaggucaacaaugaaguuauggcacucgagccagugguaggggccgcgauugcugccccgguggcaggacagcaaaacgucauagaccccuggaucagaaauaacuucgugcaggccccugguggcgaauuuacuguuucaccaaggaaugcucccggggagauucuuuggaguaugccucugagcccagauuugaaccccuacuuaucccaccugucucggauguauaauggauacgcaggcgguuucgaagugcaggucauccuagccgggaacgcuuuuacggccggaaaaauuaucuucgcggcaauaccuccaaauuuuccgaccgacggccucucgcccucacaggugacaauguucccucauaucauuguagauguucgccaacuggagccagugcuuaucccccugccugacguccgaaacaauuuuuaucacuacaaccaggugaaugauagcacuuugaagcucauugccaugcuguauaccccacugcgugcuaacaacgccggcgacgauguguucacagucaguugcagaguucucaccaggcccuccccggacuuugauuucaucuuuuuagugccucccacuguagagucucggacaaaaccauucaccgugccuauacugacggucgacgaaaugacuaauagccgcuuucccaccccacuugagagauugcauacagggcccaacaauucccuggugguucagccucagaacggaagguguacuauugauggugugcuacucggcaccacacaacugucagcagucaauaucugcaguuuccgcggggacagcaccacgcgggaaggacagucucacgcuuacacuaugaaccuugccucccagaauuggacaaacuaugacccaaccgaggauauuccggcgccccugggcacuccugacuucguggguaagaucguagggauguugucacagacaacccgagagaauagcaguacgagagcccauaaagcaaccguuucuacaggagaugcucacuuuaugccaaagcucggcuccgugcuguucacuaccgacacagaagauuuacaaaacggccagaauacuagguuuacccccgucgggguggcccaggacggagagccucaccaaaacgaaccacagcaguggcggcugcccaauuacagcgguacaccgggccauaacguccaccucgcuccuccaguggcccccaccuucccuggggagcagcuucuguuuuuccguucgacuaugcccggauguggcgguuacccaaauauggauuuggacugccuacugccucaagaauggguucgccauuuuuaucaggaggcagcccccgcucagucugauguggcgcuccugagauucguaaacccagacacggggaggguccuuuuugaguguaagcugcacaaagcaggcuacaucacagugucccacaccggaccguaugauuugguuauuccucccaacggcuacuuccgguuugacucaugggugaaucaguucuaugcccucgcuccaauggggacuggaaccggucgacgcagauga

SEQ ID NO: 21565 - RNA, 1614 nt, Artificial Sequence
  derived and/or modified sequence opt3 from VP1__Norovirus_and/or_Norovirus-like__AF427116
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacucaacaauuaaguugaucgcaaugcucuauacuccacugcgugcuaacaaugccggggaugacguguucaccgucagcugcagaguucugacaaggcccaguccggauuuugacuucauuuuucucgugccucccaccguagaaucccggacuaaaccauucacaaucccuauauuaaccguggaggaaaugucuaacagccgcuuucccauuccacuggagaaacuuuacacgggacccuccucagcguucgucgugcagccucagaaugguagauguacuaccgauggcguuuugcuggggacaacucaacuaagugccgugaacaucugcaccuucaggggaaaugucauucauaucgcaggcagccacgacuauacaaugaaccucgcuucucagaauuggaacaauuacgauccaaccgaggaaacgccggcuccccuggguacuuccgacuuuguggggaagauccagggacuucugacacagaccacucgggaggacggcucaacacgcgcccauaaggccaccguaagcacgggcaguguucacuucaccccuaaguuggggucugugcaauacacaacugauaccaacaaugacuuucagacaggacagaacacuaaauucaccccagucggugugauucaagauggcaauaaccaccagaaugaaccccagcaguggguccucccuaacuauuccgggcgagcaggacauaacgugcaccuggccccagcuguugcgcccacauuuccgggcgagcaauuacuguucuuuagaagcaccaugccugguuguucgggguacccaaauaugaaccucgacugccuucugccccaggaaugggugcagcauuucuaucaggaggcagccccugcucaaucugauguagccuugcuaagguuugucaaucccgacacuggccgggugcuguucgaguguaagcuccacaaauccggauacguuacgguggcacacacaggcccacaugaucuggucauaccucccaacggguauuuucguuucgacucaugggugaaucaguuuuacacccuugccccaaugggaaacggugcuggccgcagaagguga

SEQ ID NO: 21566 - RNA, 1614 nt, Artificial Sequence
  derived and/or modified sequence opt3 from VP1__Norovirus_and/or_Norovirus-like__KX514337
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaugacguguucacugucagcugcagaguucugaccaggcccaguccggauuuugacuucauuuuucucgugccucccacaguagaaucccggaccaaaccauucucugugccuaucuuaacugucggagagaugacaaacagccgcuuucccgugaaucuggaaagacuuuucaccgguccauccucagccaacguugugcagccccagaaugggagguguacgauagauggcgaguugcugggaacuacccaacuaaguagcgucaacauuugcacauuccggggcgacgugacucagaucggugcaacccgccauuggacaaugaaucucgcuucuccuaacuggaauaacuacgauccaaccgaggaaacgccggcuccccuggggacuccugacuuuguaggaaagguucacggcaugcuuacacagaccacucagggcuccgggucaacacgagcccauagagccaccguguaugucggaggugcagaguucacgccaaaacugggcaaggugagguuugaaaccgacacagaggaugacuuggucauucggcaaaauacuaaguucacccccguggggguuauccagagcagugaacaccaccgugaugagccucagcaauggcgccucccaaacuacucuggagccaauacauuuaacgugcaucuggcucccgcgguagcaccgaauuucccuggcgagcaguuacuguuuuucagauccacucucccagguugugggggccaccccaacauggaccuugauugccuguugccucaggaauggguccagcauuuuuaccaagaggccgcucccgcccagagcgacguggcacuacugagguucguuaacccagauaccucgcgggugcucuuugaauguaaacugcacaagucuggauaugucacaguggcccacaccggccagcaugaccuuguaaucccucccaauggguacuuccgauuugauuccugggugaaccaguucuauacucuggcuccaaugggaaaugguacgggccgcaaaagauga

SEQ ID NO: 21567 - RNA, 1614 nt, Artificial Sequence
  derived and/or modified sequence opt3 from VP1__Norovirus_and/or_Norovirus-like__KX514255
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaacguuuccgaccgagggccucucucccucgcagguaacaauguucccucauaucauaguugacgugcgccaacuggagccaguccuuaucccccugccugaugugcgaaauaacuuuuaucacuacaaucagucaaacgacagcacuauuaaguugaucgcaaugcucuauaccccacugcgugcuaauaaccccggggaugacguguucacagucaguugcagaguucugaccaggccguccccugauuuugacuucauuuuucucgugcccccaacuguagaaucucggacaaaaccuuucagcgugcccaucuuaaccgucggagagaugacgaacucccgcuuuccaauaaaucuggaaagacuuuucacuggucccucaagugccaacgugguucagccucagaaugggagguguaccauugauggcgaguugcugggaacaacucaacuaagcucugugaacaucugcaccuuccggggcgacgucacacauauugguuccacccaccauuggacgaugaaucucgcgucaccaaacuggaauaacuacgauccgacugaggaaacacccgccccucuggggaccccagacuuugugggaaagauccacggcaugcuuacucagacaacccaggagaauggcagcacgcgcgcacaccgagcuaccguauauguugggagugccgacuucacacccaaacugggaaaggugcaguuugaaacugagaccgauuacgacuuggcuaucagacaaaacacaaaguucacuccugucggugugauucaggaaucugaucaucacagggacgagccacagcaauggcggcuccccaauuacuccggcgccaacaccuuuaauguccaucuggcaccggccguggcuccuaacuucccaggggagcaguuacuguuuuuccguagcacacuccccggauguggcggucacccuaauauggaucuugacugccuguugccccaggaauggguucagcacuuuuaucaagaggcggcaccagcccagucggauguggcucuacugcgcuucguaaacccugacaccucuagaguccucuuugaauguaaacugcauaaguccggguacgugacuguugcccacacgggccaguaugaucuugugcugcccucaaacggauacuucagguuugacaguugggucaaucaguucuauacauuggcaccaaugggcaacgggaccggacggcgacgcuga

SEQ ID NO: 21568 - RNA, 1614 nt, Artificial Sequence
  derived and/or modified sequence opt3 from VP1__Norovirus_and/or_Norovirus-like__KX514210
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaacuuuuccgacggagggccucucucccucgcagguaaccauguucccucauaucauaguugacgugcgccaacuggagccaguccuuaucccccugccugaugugcgaaauaacuuuuaucacuacaaucagucaaacgacagcacaauuaaguugaucgcuaugcucuauacuccacugcgugccaauaaccccggggaugacguguucaccgucaguugcagaguucugacaaggccguccccugauuuugacuucauuuuucucgugcccccaaccguagaaucucggacuaaaccuuucagcgugcccaucuuaacagucggagagaugaccaacucccgcuuuccagugaaucuggaaagacuuuucacgggucccucaagugcgaacguugugcagccucagaaugggagguguacuauagauggcgaguugcugggaaccacacaacuaagcucugucaacauuugcacuuuccggggcgacgugacccauaucgguuccacacaccauuggaccaugaaucucgccucaccaaacuggaauaacuacgauccgacggaggaaacucccgcaccucuggggacaccagacuuuguaggaaagauucacggcaugcuuacccagacuacacagggcagcgggaguacccgcgcucaccgagccacgguuuaugugggaucugcugaguucacccccaaacuggguaagguccaguuuaagacagaaacugaccaugauuuguccaccagacaaaauacaaaauucacuccugugggcgucauccaggagagcgaccaccauagggaugaaccacagcaauggcggcuccccaacuacucgggggccaauaccuuuaacgugcaccuggcaccggccguugcuccuaauuucccaggagagcaguuacuguuuuuccguucuacacuccccggcuguggugggcacccuaacauggaccuugauugccuguugccccaggagugggugcagcauuuuuaccaagaagcggcaccagcccaguccgacguagcucuacugcgcuucgucaauccugauaccucaagagugcucuuugaguguaagcugcacaaaaguggcuauguuacuguggcccauacgggacaguacgaccuuguccugcccagcaacggcuauuucagguuugauuccugggugaaccaguucuacacauuggcaccaauggggaauggaaccggucggcgacgcuga

SEQ ID NO: 21569 - RNA, 1614 nt, Artificial Sequence
  derived and/or modified sequence opt3 from VP1__Norovirus_and/or_Norovirus-like__KX514182
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaacuuuuccgacggagggccucucucccucgcagguaaccauguucccucauaucauaguugacgugcgccaacuggagccaguccuuaucccccugccugaugugcgaaauaacuuuuaucacuacaaucagucaaacgacagcacaauuaaguugaucgcuaugcucuauacuccacugcgugccaauaaccccggggaugacguguucaccgucaguugcagaguucugacaaggccguccccugauuuugacuucauuuuucucgugcccccaaccguagaaucucggacuaaaccuuucagcgugcccaucuuaacagucggagagaugaccaacucccgcuuuccagugaaucuggaaagacuuuucacgggucccucaagugcgaacguugugcagccucagaaugggagguguacuauagauggcgaguugcugggaaccacacaacuaagcucugucaacauuugcacuuuccggggcgacgugacccauaucgguacaacccagcacuggacgaugaaucucgccuccccaaacuggaauaacuacgauccgacugaggaaacacccgcaccucuggggaccccagacuuuguaggaaagauucauggcaugcuuacucagacaacccagggcucagggagcacgcgcgcucaccgagccaccguuuaugugggaagugcugaguucacacccaaacuggguaaggucagauuugaaacugacaccgaggaugacuuggugaucaggcaaaauacaaaguucacuccugucggcgugauccagucuuccgaacaccaucgggaugagccacagcaauggcgucuccccaacuacagcggggccaauaccuuuaacguucaccuggcaccggccguggcuccuaauuucccaggagagcaguuacuguuuuuccgcucgacacuccccggcuguggugggcauccuaacauggaccuugauugccuguugccccaggaauggguacagcacuuuuaccaagaggcggcaccagcccagucugacgucgcucuacugagauucgugaauccugauaccuccaggguucucuuugaauguaaacugcacaagucaggcuaugugacugucgcccauacgggacaguacgaccuugugcugcccaguaacggcuauuuccgguuugauagcuggguaaaccaguucuacacauuggcaccaauggggaauggaaccggucgaaaacgcuga

SEQ ID NO: 21570 - RNA, 1614 nt, Artificial Sequence
  derived and/or modified sequence opt3 from VP1__Norovirus_and/or_Norovirus-like__AF425764
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcggguuuacaguuucaccaaggaacgcacccggagaaauccuuuggagugccccucugggcccagauuugaaucccuacuuaagccaccuggcucggauguauaacgguuacgccgggggauucgaggugcaggucauucuagcgggcuccgcaucuacugccggcaaaaucauuuuugcugccgugccuccaaauuucccgacggaagggcucucgcccucacagguaaccauguuuccucauaucauaguugacgugcgccaacuggagccaguccuuaucccccugccugaugugcgaaacaauuucuaucacuacaaccagagcaaugacaguacaauuaaguugaucgcaaugcucuauacuccacugcgugcuaacaacgccggagaugacguguuuaccgucuccugcagaguucugacaaggcccucuccggauuucgacuuuauuuuccucgugccucccaccguagagagccggacuaaaccauuuacagugccuaucuuaaccgucgaagagauguccaauucacgcuuccccauaccacuggaaaaacuuuacacgggucccaguagcgcguuugugguucagccucagaacggcagauguacuaccgaugggguguugcugggaacaacucaacuaucugccgucaauauuugcaccuucaggggcgacgugacacauaucgcagguucccacgauuauaccaugaaccucgcuucacagaauuggaacaauuacgacccaacggaggagauuccggcuccccuggggacuccugacuucguaggaaagauccagggcaugcuuacacagaccacucgggaagauggcagcacacgcgcccauaaggccaccguuaguacggggucugugcacuuuaccccaaagcugggauccguccaauacacaacugacaccaacaaugauuuccagacaggucagaacacuaaauuuacccccgugggcgucauccaagacgggaauaaccaccagaaugagccucagcaguggguguugccaaacuauagcggacgaacaggccauaauguucaccucgcacccgccguggcuccgaccuucccuggugaacaacuguuauuuuucagaucgacuaugccaggguguucuggcuaccccaacaugaaccuggauugccuccuuccucaggaguggguacagcauuuuuaucaggaagcggcacccgcccaauccgacgucgcucuguugagguucgugaauccagauacgggacggguucuauuugaguguaagcugcacaaaucaggcuacgugacagucgcccacaccgggccucaugaccucgugauucccccaaacggauauuuccguuuugauaguuggguaaaucaguucuacacucuggcaccgauggguaacggcgccgggcgcagaagguga

SEQ ID NO: 21571 - RNA, 1614 nt, Artificial Sequence
  derived and/or modified sequence opt3 from VP1__Norovirus_and/or_Norovirus-like__KX514355
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaacguuuccgaccgagggccucucucccucgcagguaacaauguucccucauaucauaguugacgugcgccaacuggagccaguccuuaucccccugccugaugugcgaaauaacuuuuaucacuacaaucagucaaacgacagcacuauuaaguugaucgcaaugcucuauaccccacugcgugcuaauaaccccggggaugacguguucacagucaguugcagaguucugaccaggccguccccugauuuugacuucauuuuucucgugcccccaacuguagaaucucggacaaaaccuuucagcgugcccaucuuaaccgucggagagaugacgaacucccgcuuuccaauaaaucuggaaagacuuuucacuggucccucaagugccaacgugguucagccucagaaugggagguguaccauugauggcgaguugcugggaacaacucaacuaagcucugugaacaucugcaccuuccggggcgacgucacacagauugguuccacccagcauuggacgaugaaucucgcgucaccaaacuggaauaacuacgauccgacugaggaaacacccgccccucuggggaccccagacuuugugggaaagauccacggcaugcuuacucagacaacccaagagaauggcagcacgcgcgcacaucgagcuaccguauauguugggggagccaacuucacacccaaacuggguaaggugcaguuugaaacugacaccagugaugacuuggcuaucagacagaauacaaaguucacuccugucggcgugauucaaucuuccgaucaccacagggacgagccacagcaguggcggcuccccaacuacagcggggccaauaccuuuaacguccaucuggcaccggccguggcuccuaauuucccaggagaacaguuacuguuuuuccguucgacacuccccggcuguggugggcacccuaacauggaucuugacugccuguugccccaagaguggguucagcauuuuuaccaggaggcggcaccagcccagucugauguggcucuacugcgcuucguaaacccugacaccuccagaguccucuuugaauguaaacugcacaagucaggcuaugugacuguugcccacacgggacaauacgaucuugugcugcccaguaauggcuauuucagguuugacagcugggucaaccaguucuacacauuggcaccaauggggaauggaaccggucggcgacgcuga

SEQ ID NO: 21572 - RNA, 1614 nt, Artificial Sequence
  derived and/or modified sequence opt3 from VP1__Norovirus_and/or_Norovirus-like__KX514345
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaugacguguucacugucagcugcagaguucugaccaggcccaguccggauuuugacuucauuuuucucgugccucccacaguagaaucccggucuaaaccauucagcgugccugucuuaaccguggaggaaaugacuaacucccgcuuucccguuaaucuggagagacuuuucacaggaccaucaagugccaacgugguccagccccagaaugguagguguaccaucgauggcgaguugcuggggacgacucaacuaagcucugugaacauaugcaccuuccggggagacguaacacagauuggcgcaacucgccauuggaccaugaaucucgcuucccugaacuggaauaacuacgauccuacagaagagaccccagccccgcuugguacgcccgacuuuguugggaagauccacggaaugcugacucagacaacccagggcucaggcagcacucgagcucauagagccacaguguaugucggggcagccgaguucaccccuaaauugggaaaggugagguuugaaacggacaccgaagaugaccucgucauucggcaaaauacaaaguucacuccaguggguguuauccagaguucugagcaccaccgugaugagccccagcaauggcgccugccuaacuacuccggcgcuaauaccuuuaacgugcauuuagcgccagcaguagcccccaauuucccgggggaacagcugcucuuuuucagaagcacacuuccuggauguggcggucacccaaacauggaccuggauugcuugcuaccccaggaguggguccagcauuuuuaccaagaagcugccccugcacagucggacguggcccugcucagguucguuaaccccgauacuucucgggugcuguuugaguguaaacuucacaaguccggguaugucaccguggcucacacaggccaguacgaccugguauugccaucaaauggauauuuccgauuugauaguugggugaaccaguucuacacccucgccccuaugggcaaugggacuggacgcagaagguga

SEQ ID NO: 21573 - RNA, 1614 nt, Artificial Sequence
  derived and/or modified sequence opt3 from VP1__Norovirus_and/or_Norovirus-like__KX514204
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaacuuuuccgacggagggccucucucccucgcagguaaccauguucccucauaucauaguugacgugcgccaacuggagccaguccuuaucccccugccugaugugcgaaauaacuuuuaucacuacaaucagucaaacgacagcacaauuaaguugaucgcuaugcucuauacuccacugcgugccaauaaccccggggaugacguguucaccgucaguugcagaguucugacaaggccguccccugauuuugacuucauuuuucucgugcccccaaccguagaaucucggacuaaaccuuucagcgugcccaucuuaacagucggagagaugaccaacucccgcuuuccaauaaaucuggaaagacuuuucacgggucccucaagugcgaacgugguucagccucagaaugggagguguacuauugauggcgaguugcugggaaccacacaacuaagcucugugaacaucugcacuuuccggggcgacgucacccauauugguuccacacaccauuggaccaugaaucucgccucaccaaacuggaauaacuacgauccgacggaggaaacucccgcaccucuggggacaccagacuuugugggaaagauccacggcaugcuuacccagacuacacagggcagcgggaguacccgcgcucaccgagccacgguauauguuggaggugcugaguucacccccaaacugggcaaggugcaguuuaagacagaaacugaccaugauuugucuaucagacaaaauaccaaauucacaccugucggggugauucaggaguccgaccaccauagggaugaaccacagcaauggcggcuccccaacuacagcggagccaauacuuuuaacguccaccuggcaccggccguggcuccuaauuucccaggcgagcaguuacuguuuuuccguucgacccuccccgguugugggggccacccuaacauggaccuugauugccuguugccccaggaguggguucagcauuuuuaccaagaagcggcaccagcccagucugacguggcucuacugcgcuucguaaauccugauacauccagaguccucuuugaguguaagcugcacaaaucaggauaugugaccguugcccauacuggccaguacgaccuugugcugcccaguaacggguauuucagguuugauagcugggucaaccaguucuacacguuggcaccaaugggaaaugguacaggccggcgacgcuga

SEQ ID NO: 21574 - RNA, 1614 nt, Artificial Sequence
  derived and/or modified sequence opt3 from VP1__Norovirus_and/or_Norovirus-like__KF712492
augaagauggccagcuccgacgcuaaccccucugauggcucaaccgcaaaucuggugccugaggccaacaaugaagucauggcgcucgagccaguugugggggcugccaucgcagccccgguagcuggacagcaaaacgugauugaccccuggauaagaaauaacuucguccaggcaccugguggcgaauuuacagugaguccaaggaaugcccccggggagauccuuuggagcgcuccucugggaccagauuugaaccccuacuuaucccaccugucucggauguauaauggcuacgccgguggguucgaaguucaggugauucuagcgggaaacgcauuugccgcuggcaaaaucauuuucgccgcagucccuccaaauuuuccgacugagggccucucgcccucacaggugacgauguucccucaucugaucguagacguucgccaacuugagccagugaugauaccccugccugauauccgaaacaauuuuuaucacuacaaccagagcaaugacccaaccauuaaguugaucgcuaugcucuauacaccccugcgugccaacaacgucggggaugacguguucacugugaguugcagaguccugaccaggccguccccugauuuugacuucauuuuucucguucccccaacaguggaaucuaaaaccaauccuuucagcguacccaucuuaacuauagaggaaaugacaaacucccgguuuccaauuccccuggagaaacuuuucaccggaccuucaagugcguuggugguccagccacagaauggucgcuguacgacugauggcgugcugcuagggaccacacaacucagcccgguuaacaucugcacuuucagaggagacgugacccauacaaccaagacgcacacuuaccagaugaaucuggccgcacagaacuggaacucuuaugaucccacagaggaaauuccugcuccacuuggcacccccgacuuugucgguaagauccagggggugcugacucaaacaaccaagggaaauggcuccacgagggcccauaaagcuaccguauacacaggcucagccgaguucacuccuaaguuggggcggauccagcucuuuaccgacacagauaaugaccuggaagcaaaccagaauacuaaauucaccccaguuggagugauucaagauggugacacacaccagaacgagccccagcagugggucuuaccgagcuacaguggccgcaauaaccacaaugugcaucuggccccugcugucgcgccaaccuuucccggggaacaacuccuuuucuuucgaucuacuaugccuggauguuccggcuaucccaacaugaaccuggauugcuugcuaccacaggagugggugcaguacuucuaucaggaggcagccccugcucaaagcgacguugcccugcucagauuugugaaucccgauacggguaggguacuguucgaauguaaacuucacaagucgggguacgucacaguggcacauaccggccaccacgaccuguuuauaccaccgaacggauauuuccgguuugauucuuggguuuccccuuucuacacuuuggcccccaugggcaaugggaccggacgucgcagauga

SEQ ID NO: 21575 - RNA, 1614 nt, Artificial Sequence
  derived and/or modified sequence opt3 from VP1__Norovirus_and/or_Norovirus-like__DQ078829
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacccuagccacuuagcccggauguauaacggcuacgcggguggguucgaagugcaggucauucuggcaggaaaugccuuuacagcuggcaaaaucauuuucgccgcagugccaccgaacuuucccacugagggccuauccccuucucagguaacgauguucccacauaucauaguugacgugcgccaacucgaucccguccugaucccuucgccagacgugcgaaauaacuuuuaucacuacaaucagucaaacgauagcaccauuaaguugaucgcuaugcuguauacacccuugcgugccaacaaugcgggggacgauguguucacugucaguugcagaguucucaccaggccguccccugacuuugauuucauuuuucuggugcccccaacaguagagucucggaccaaaccuuucacugugcccauccugacagucgaagagaugagcaacucccgcuuuccaauaccccucgaaaaguuauacaccggaccuucaagugccuucgugguucagccacagaaugguagauguacgacugacggcgugcugcuugggaccacacaauugagcgcagucaacauuugcacuuucaggggagaugugacccauaucgcuggcucucacgacuauacaaugaaucuggccucccagaacuggauuaauuacgacccgaccgaggagauccccgcuccucuagguacgccagauuuuguagggaaaauccagggaaugcucacucagacaacccgggaagacggcucaacucgcgcccauaaggcaacaguuagcaccggcagugugcacuucacgcccaagcuggggucuguccaauacaccacagauacuaacaaugacuuucagaccggacaggauacaaaauucacuccugugggugucauucaagacggcaacaaucaccagaacgagccacagcagugggugcuucccaauuauuccgggcgaaccggacauaacguucaccuggccccggcuguggcgccuacauuuccaggcgaacaacuucucuucuuuagaagcaccaugcccgguuguucgggguacccuaauaugaaccuggauugcuuacugccccaggaguggguacagcauuucuaucaggaagcagccccagcucaaccugacgucgcccuccuuagguuugugaaccccgauacuggccggguucuguucgaguguaaguugcacaaaucuggauacgugacggucgcacacacaggcccacaugaccuagugauaccgccuaauggguauuuucguuucgauuccuggguaaaccaguuuuacacccuggcccccaugggaaauggugcuggccgcagaagguga

SEQ ID NO: 21576 - RNA, 1614 nt, Artificial Sequence
  derived and/or modified sequence opt3 from VP1__Norovirus_and/or_Norovirus-like__KX514370
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaacuuuuccgacggagggccucucccccucucagguaaccauguucccucauaucauaguugacgugcgccaacuggagccaguccuuaucccccugccugaugugcgaaacaauuuuuaucacuacaaccagucgaaugacucaacaauuaaguugaucgcuaugcucuauacuccacugcgugccaacaaccccggggaugacguguucaccgucagcugcagaguucugacaaggccgaguccugauuuugacuucauuuuucucgugcccccaaccguagaaucccggacuaaaccuuucucugugcccaucuuaacagucggagagaugaccaauagccgcuuuccagugaaccuggaaagacuuuucacgggucccuccucagcgaauguugugcagccucagaacgggagguguacuauagauggcgaguugcugggaaccacacaacuaaguagcgucaauauuugcacuuuccggggcgacgugacccagaucggugccacacgccauuggaccaugaaccucgcaucuccaaauuggaacaauuacgauccgacggaggaaacucccgcuccucuggggacaccagacuuuguaggaaagauucacggcaugcuuacccagacuacacagggcuccgggucaacccgagcccauagagcuacgguuuaugugggaggugccgaguucacccccaaacugggcaaggucagguuugaaacagacacugaggaugacuuggugauccggcaaaacaccaaguucacaccugucggggugauccagagcagugaacaccaccgugaugagccacagcaauggcgccuccccaauuacucuggagcaaacacuuuuaauguucaucuggccccggcuguggcgccuaacuucccaggcgagcaguuacuguuuuucagauccacccuccccgguugugggggccacccuaauauggaccuugauugccuguugccccaggaauggguacagcauuuuuaccaagaggcagccccagcucagagcgacgucgcccuacugagguucgugaacccugauacaucgcggguucucuuugaauguaaacugcacaagucuggauaugugaccgucgcacacacuggccaguacgaccuugugcugcccuccaacggguauuuccgauuugauucauggguaaaucaguucuacacguuggccccaaugggaaacgguacaggccgcagaagguga

SEQ ID NO: 21577 - RNA, 1614 nt, Artificial Sequence
  derived and/or modified sequence opt3 from VP1__Norovirus_and/or_Norovirus-like__KX514332
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaacguuuccgaccgagggccucucucccucgcagguaacaauguucccucauaucauaguugacgugcgccaacuggagccaguccuuaucccccugccugaugugcgaaauaacuuuuaucacuacaaucagucaaacgacagcacuauuaaguugaucgcaaugcucuauaccccacugcgugcuaauaaccccggggaugacguguucacagucaguugcagaguucugaccaggccguccccugauuuugacuucauuuuucucgugcccccaacuguagaaucucggacaaaaccuuucagcgugcccaucuuaaccgucggagagaugacgaacucccgcuuuccaauaaaucuggaaagacuuuucacuggucccucaagugccaacgugguucagccucagaaugggagguguaccauugauggcgaguugcugggaacaacucaacuaagcucugugaacaucugcaccuuccggggcgacgucacacagauugguuccaccaagcauuggacgaugaaucucgcgucaccaaacuggaauaacuacgauccgacugaggaaacacccgccccucuggggaccccagacuuugugggaaaaauccacggcaugcuuacucagacaacccaggagaauggcagcacgcgcgcacaucgagcuaccguauauguugggggagccaacuucacacccaagcuggguaaggugcaauuugaaacugacaccgucgaugacuuggagaucagacagaauacaaaauucacuccugugggcgucauucagaguucugaucaccacagggacgaaccacaacaguggcggcuccccaacuacuccggggcuaauaccuuuaacgugcaucuggccccggcaguugccccuaauuucccaggagagcaguuacuguuuuuccguagcacacuccccggcuguggugggcacccuaacauggaucuugacugccuguugccccaggagugggugcaacauuuuuaccaggaagcugcgccagcacagucggauguagcccuacugcgcuucgucaacccugacaccucuagagugcucuuugaguguaagcugcacaaauccggcuauguuacuguggcucacacgggacaguacgaucuuguccugcccucaaauggcuauuucagguuugacaguugggugaaccaauucuacacauuggccccaauggggaauggaaccggucggcgacgcuga

SEQ ID NO: 21578 - RNA, 1614 nt, Artificial Sequence
  derived and/or modified sequence opt3 from VP1__Norovirus_and/or_Norovirus-like__KX514276
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaacuuuuccgacggagggccucucucccucgcagguaaccauguucccucauaucauaguugacgugcgccaacuggagccaguccuuaucccccugccugaugugcgaaauaacuuuuaucacuacaaucagucaaacgacagcacaauuaaguugaucgcuaugcucuauacuccacugcgugccaauaaccccggggaugacguguucaccgucaguugcagaguucugacaaggccguccccugauuuugacuucauuuuucucgugcccccaaccguagaaucucggacuaaaccuuucagcgugcccaucuuaacagucggagagaugaccaacucccgcuuuccagugaaucuggaaagacuuuucacgggucccucaagugcgaacguugugcagccucagaaugggagguguacuauagauggcgaguugcugggaaccacacaacuaagcucugucaacauuugcacuuuccggggcgacgugacccauaucgguacaacccaccauuggacgaugaaucucgccuccccaaacuggaauaacuacgauccgacugaggaaacacccgcaccucuggggaccccagacuuuguaggaaagauucacggcaugcuuacucagacaacccagggcucagggagcacgcgcgcucaccgagccaccguuuaugugggaagugcugaguucacacccaaacuggguaaggucagauuugaaacugacaccgaggaugacuuggugaucaggcagaauacaaaguucacuccugucggcgugauccaaucuuccgaucaucaccgggacgaaccacagcaguggcgucuccccaacuacagcggggccaauaccuuuaacguucaucuggcaccggccguggcuccuaauuucccaggagagcaauuacuguuuuuccgcucgacacuccccggcuguggugggcacccuaacauggaucuugacugccuguugccccaggaguggguacagcacuuuuaccaggaagcggcaccagcccaaucugaugucgcucuacugagauucgugaauccugacaccuccaggguucucuuugaguguaaacugcauaagucaggcuaugugacugucgcccacacgggacaguacgaucuugugcugcccaguaacggcuauuuccgguuugacagcuggguaaaccaguucuacacauuggcaccaauggggaauggaaccggucgacgcagauga

SEQ ID NO: 21579 - RNA, 1614 nt, Artificial Sequence
  derived and/or modified sequence opt3 from VP1__Norovirus_and/or_Norovirus-like__KX514256
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaacuuuuccgacggagggccucucucccucgcagguaaccauguucccucauaucauaguugacgugcgccaacuggagccaguccuuaucccccugccugaugugcgaaauaacuuuuaucacuacaaucagucaaacgacagcacaauuaaguugaucgcuaugcucuauacuccacugcgugccaauaaccccggggaugacguguucaccgucaguugcagaguucugacaaggccguccccugauuuugacuucauuuuucucgugcccccaaccguagaaucucggacuaaaccuuucagcgugcccaucuuaacagucggagagaugaccaacucccgcuuuccaauaaaucuggaaggucuuuucacgggccccucaagugcgaacgugguucagccucagaaugggagauguacuauugauggagaguugcugggcaccacacaacuaagcucugugaacaucugcacuuucaggggugacgucacccauauuggguccacacaccauuggaccaugaaucucgccucaccaaacuggaauagcuacgauccgacggaggaaacucccgcaccucugggaacaccagacuuugugggcaagauccacggcaugcuuacccagacuacacaggggaguggaucuacccgggcucaccgcgccacgguauauguugguuccgcugaguucacccccaaacugggcaaggugcaguuuaagacagaaacuaaccaugacuugagcauccgacaaaauaccaaauucacaccugucggggugauucaggagucggaucaccauagagacgaaccacagcaauggaggcuccccaacuacucuggagccaauacuuuuaacguccaccuggcaccggccguggcuccuaauuucccaggcgagcaguuacuguuuuuccgguccacccuccccgguugugggggccacccuaacauggaucuugacugccuguugccccaggaguggguucagcauuuuuaccaagaagcggcaccagcccagucagauguggcucuacugcguuucguaaauccugacacaagucgcguccucuuugaguguaagcugcacaaaagcggauaugugaccguugcccauacuggccaguacgaucuugugcugcccccaaacggguauuucagauuugacuccugggucaaccaguucuacacguuggcaccgaugggaaaugguacaggcaggcggcgauga

SEQ ID NO: 21580 - RNA, 1614 nt, Artificial Sequence
  derived and/or modified sequence opt3 from VP1__Norovirus_and/or_Norovirus-like__KX514209
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaacuuuuccgacggagggccucucucccucgcagguaaccauguucccucauaucauaguugacgugcgccaacuggagccaguccuuaucccccugccugaugugcgaaauaacuuuuaucacuacaaucagucaaacgacagcacaauuaaguugaucgcuaugcucuauacuccacugcgugccaauaaccccggggaugacguguucaccgucaguugcagaguucugacaaggccguccccugauuuugaccucauuuucuuagugcccccaaccguagaaucucggacuaaaccuuuuagcgugcccauccugacagucggagagaugaccaacucccgcuucccagugaaucuugaaagauuguuuacgggucccucaagugcgaacguugugcagccucagaaugggagguguacuauagauggcgagcugcuaggaaccacacaacucagcucugucaacauuugcacuuuccggggcgacgugacccauaucgguuccacacaccauuggaccaugaaucuggccucaccaaacuggaauaacuacgauccgacggaggaaacucccgcaccucuugggacaccagacuucguaggaaagauucacggcaugcugacccagacuacacagggcagcgggaguacccgcgcucaccgagccacgguuuaugugggaucugcugaguuuacccccaaauuggguaagguccaguucaagacagaaacugaccaugaucucuccaucagacaaaauaccaaauuuacaccugugggcgucauccaggagagcgaccaccauagggaugaaccacagcaauggcggcugcccaacuacucgggggccaauacuuucaacgugcacuuagcaccggccguugcuccuaauuuuccaggagagcagcuucucuucuuucguucuacccuucccggcuguggugggcacccuaacauggaccuggauugcuugcuaccccaggagugggugcagcauuucuaccaagaagcggcaccagcccaguccgacguagcucugcuccgcuuugucaauccugauacaucaagagugcuguucgaguguaagcugcacaaaaguggcuauguuaccguggcccauacuggacaguacgaccuggucuugcccagcaacggcuauuuuagguucgauuccugggugaaccaguuuuacacgcucgcaccaauggggaauggaacaggucggcgacgcuga

SEQ ID NO: 21581 - RNA, 1614 nt, Artificial Sequence
  derived and/or modified sequence opt3 from VP1__Norovirus_and/or_Norovirus-like__KX514205
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaacuuuuccgacggagggccucucucccucgcagguaaccauguucccucauaucauaguugacgugcgccaacuggagccaguccuuaucccccugccugaugugcgaaauaacuuuuaucacuacaaucagucaaacgacagcacaauuaaguugaucgcuaugcucuauacuccacugcgugccaauaaccccggggaugacguguucaccgucaguugcagaguucugacaaggccguccccugauuuugacuucauuuuucucgugcccccaaccguagaaucucggacuaaaccuuucagcgugcccaucuuaacagucggagagaugaccaacucccgcuuuccaauaaaucuggaaagacuuuucacgggucccucaagugcgaacgugguucagccucagaaugggagguguacuauugauggcgaguugcugggaaccacacaacuaagcucugugaacaucugcacuuuccggggcgacgucacccauauugguuccacacaccauuggaccaugaaucucgccucaccaaacuggaauaacuacgauccgacggaggaaacucccgcaccucuggggacaccagacuuugugggaaagauccacggcaugcuuacccagacuacacagggcagcgggaguacccgcgcucaccgagccacgguauauguuggaggugcugaguucacccccaaacugggcaaggugcaguuuaagacagaaacugaccaugauuugucuaucagacaaaauaccaaauucacaccugucggggugauucaggaguccgaccaccauagggaugaaccacagcaauggcggcuccccaacuacagcggagccaauacuuuuaacguccaccuggcaccggccguggcuccuaauuucccaggcgagcaguuacuguuuuuccguucgacccuccccgguugugggggccacccuaacauggaccuugauugccuguugccccaggaguggguucagcauuuuuaccaagaagcggcaccagcccagucugacguggcucuacugcgcuucguaaauccugauacauccagaguccucuuugaguguaagcugcacaaaucaggauaugugaccguugcccauacuggccagcacgaccuugugauacccccaaacggguacuucagguuugauaguugggucaaccaguucuauacgcuggcaccgaugggaaaugguacaggccggcgacgcuga

SEQ ID NO: 21582 - RNA, 1614 nt, Artificial Sequence
  derived and/or modified sequence opt3 from VP1__Norovirus_and/or_Norovirus-like__KX514200
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaacuuuuccgacggagggccucucucccucgcagguaaccauguucccucauaucauaguugacgugcgccaacuggagccaguccuuaucccccugccugaugugcgaaauaacuuuuaucacuacaaucagucaaacgacagcacaauuaaguugaucgcuaugcucuauacuccacugcgugccaauaaccccggggaugacguguucaccgucaguugcagaguucugacaaggccguccccugauuuugacuucauuuuucucgugcccccaaccguagaaucucggacuaaaccuuucagcgugcccaucuuaacagucggagagaugaccaacucccgcuuuccaauaaaucuggaaagacuuuucacgggucccucaagugcgaacgugguucagccucagaaugggagguguacuauugauggcgaguugcugggaaccacacaacuaagcccagugaacaucugcacuuuccggggcgacgucacccauauugguacaacccgccacuggacgaugaaucucgccucuccgaacuggaauaacuacgaucccacugaggaaaccccugcaccacuggggacacccgacuuugugggaaagauccauggcaugcuuacucagacaacccagggcuccgggucaacgcgagcucacagagccaccguauauguuggaagcgcugaguucacaccuaaacuggguaaggugcaguuuaagacugaaaccgaccacgauuugaguaucaggcaaaauacaaaauucacuccagucggcgugauucagaagucugaccaucaccgggaugagccccagcaauggcgucucccgaacuacuccggggccaauaccuuuaacguccaucuggccccugcaguggcuccaaauuuccccggagaacaguuacuguuuuuccgcagcacacucccuggcuguggugggcaccccaacauggaccuugauugccuguugccacaggaguggguucagcacuuuuaccaagaggcggccccugcacagucggacguggcucuacugagauucguaaaucccgauaccucuaggguccucuuugaauguaaacugcauaaguccggcuaugugacuguugcccacacgggacaguacgaccuugugcugccaucaaacggcuauuuccgguuugauaguugggucaaccaguucuacacauuggcaccgauggggaauggaaccggucgacgcagauga

SEQ ID NO: 21583 - RNA, 1614 nt, Artificial Sequence
  derived and/or modified sequence opt3 from VP1__Norovirus_and/or_Norovirus-like__KX514196
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacguguuuacagccggcaaaaucauuuucgcugccguaccuccaacuuuuccgacggagggccucucucccucgcagguuaccauguucccucauaucauaguggacguccgccaacuggagccagugcuuaucccccugccugaugugcgaaauaacuuuuaucacuacaaucagucaaacgacagcacaauuaaguugaucgcaaugcucuauacuccacugcgugcuaauaaccccggggaugacgucuucaccguuaguugcagagugcugacaaggccguccccugauuuugacuucauuuuucucguacccccaaccguggaaucucggacuaaaccuuucagcguccccaucuuaacagugggagagaugaccaacucccgcuuuccaauaaaucuggaaagacuuuucacgggucccucaagugccaacguugugcagccucagaaugggagguguacuauugauggcgaguugcugggaaccacacaacuaagcucugucaacaucugcacuuuccggggcgacgugacccauauugguuccacacaccauuggaccaugaaucucgcgucaccaaacuggaauaacuacgauccgacggaggaaacucccgccccucuggggacaccagacuuuguaggaaagauccacggcaugcuuacccagacuacacagggcagcgggaguacccgcgcacaccgagcuacgguuuaugugggaggugccgaguucacccccaaacugggcaagguccaguuuaagacagaaacugaccaugauuugaccaucagacaaaauacaaaauucacuccugugggggucauucaggagucugaccaccauagggaugaaccacagcaauggcggcuccccaacuacuccggagcuaauaccuuuaacgugcaccuggccccggcaguugccccuaauuucccaggcgagcaguuacuguuuuuccguagcacacuccccgguugugggggccacccuaacauggaccuugauugccuguugccccaggagugggugcagcauuuuuaccaagaagcugcgccagcacagucggacguagcccuacugcgcuucgucaauccugauaccucuagagugcucuuugaguguaagcugcacaaauccggauauguuacuguggcucauacgggccaguacgaccuuguccugcccucaaacggguauuucagguuugauaguugggugaaccaguucuacacauuggccccaaugggaaaugguaccggccggcgacgcuga

SEQ ID NO: 21584 - RNA, 1614 nt, Artificial Sequence
  derived and/or modified sequence opt3 from VP1__Norovirus_and/or_Norovirus-like__AB985437
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccugucccggauguauaacggcuacgccgguggguucgaagugcaggucauucuagcgggaaaugcauuuacagccggcaaagugaucuucgcugccguaccuccaaacuuuccgacugagggccucucucccucgcagguuacgauguucccucauauuaucguggacguccgccaacuggagccagugcuuauaccccugccugaugugcgaaauaacuuuuaucacuacaaucaggcacaugacucaaccuugaagcucaucgcuaugcuguauacaccacugcgugccaacaacgcgggggaugacgucuucacuguuagcugcagagugcucaccaggcccaguccggauuuugacuucaucuuuuuaguaccucccacaguggaaucccggaccaaaccauucacugucccuauccugacaguggaggaaaugucuaauagccgcuuucccauuccacuugagaaguuguacaccggacccuccucagccuucguugugcagccucagaacgguagauguacgacugauggcguccugcuagggaccacacaacucagugcagugaauaucugcaacuucaggggagacguaacucacauaguuggcagccaugauuauaccaugaaucuggugucucagaacuggaauaacuacgacccaacagaggaaauuccggcuccccuugguaccccugacuuugucgggaaaauccagggacuguugacgcagacuacacgggccgauggcuccacccgcgcucacaaggccacugugucaacaggcagcguccacuucaccccaaagcucgggagugugcaauuuacgaccgacacaaauaacgauuuccagacuggacagaauaccaaauuuacacccguuggugugauucaagacggcgaucaucaccagaacgagccucagcaguggguacugccaaauuacucugggacuuccggacauaacguccacuuagcacccgccguggcuccgaccuucccuggcgaacaacugcucuuuuuccgaagcacaaugccagguuguucgggguaucccaauaugaaccuugacugccuguugccucaggaguggguucuacacuuuuaccaggaagcggcacccgcccagucugauguggcucugcucagauucgucaacccagacaccggcagggugcuguuugaguguaaacuucauaaguccucauauaucacuguagcccacacgggaccuuacgaucuggugauucccccaaauggcuauuuccgguuugacaguuggguuaaccauuucuacacauuggcaccgauggggaauggaaccgguggccgucgcuga

SEQ ID NO: 21585 - RNA, 1614 nt, Artificial Sequence
  derived and/or modified sequence opt3 from VP1__Norovirus_and/or_Norovirus-like__KF712494
augaagauggccagcuccgacgcuaaccccucugauggcucaaccgcaaaucuggugccugaggccaacaaugaagucauggcgcucgagccaguugugggggcugccaucgcagccccgguagcuggacagcaaaacgugauugaccccuggauaagaaauaacuucguccaggcaccugguggcgaauuuacagugaguccaaggaaugcccccggggagguucuuuggagcgcuccucugggaccagauuugaaccccuacuuaucccaccuggcccggauguauaauggcuacgcggguggguucgaagugcaggucauccuagcaggaaacgccuuugcugccggcaaaauuaucuucgcagcugugccuccaaauuuuccgacugagggccucucucccucgcagguaacgauguucccucaucugauuaucgacguucgccaacuugagccagugaugauaccccugccugauguccgaaacaauuuuuaucacuacaaccagucaaaugacccaaccaucaaguugauugccaugcucuauacaccccugcgugcgaacaacgugggggaugacguguucacugucagcugcagaguucugaccaggccgaguccugauuuugacuucaucuuucucgugcccccaacaguagaauccaaaaccaauccuuucucugugcccauuuuaacuaucgaggaaaugacaaacagccgguuuccaauaccccuggagaaacuuuucaccggaccuuccucagccuuggucgugcagccacagaauggucgcuguacgacugauggcguucugcuagggaccacacaacucaguccggugaacauuugcacuuucagaggagacgucacccauaucacaaagacccacagcuaccagaugaaucuggcagcucagaacuggaacucuuaugaucccacggaggaaauuccugccccacuuggcacucccgacuuuguggguaagauccaggggguacugacacaaaccacuaagggaaauggcuccacaagggcucauaaagccaccguuuacacgggcucaaccgaguucacaccuaaguuggggcggauccagcucgugacugacaccgauaaugaccuggaaacaaaccagaauacuaaauuuaccccagucggagugauucaagauggugacacacaccagaacgagccccagcagugggucuuaccgagcuaccugggccgcaauaaccacaaugugcaucucgccccugcaguugcuccaaccuuccccggggaacaacuucuguuuuuccgaaguacuaugccuggauguucuggcuaucccaacaugaacuuggauugccuacugccacaggagugggugcaguacuuuuaucaggaggcggccccugcacaauccgacguagcucuccugagauucgucaaucccgauacggguagggugcuuuuugaauguaagcugcacaaaagcggguacguuacaguggcccauaccggccaccacgacuuguucauaccaccgaacggauauuuucgguucgauucgugggucucuccuuuuuacacucucgcacccaugggcaaugggaccggacgucgcagauga

SEQ ID NO: 21586 - RNA, 1614 nt, Artificial Sequence
  derived and/or modified sequence opt3 from VP1__Norovirus_and/or_Norovirus-like__KX514315
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaaccccggggaugacguguucaccgucaguugcagaguucugacaaggccguccccugauuuugacuucauuuuucucgugcccccaaccguagaaucucggacuaaaccuuucagcgugcccaucuuaacagucggagagaugaccaauucccgcuuuccaauaaaccuggaaagacuuuucacgggucccucaagugccaaugugguucagccucagaacgggagguguacuauugauggcgaguugcugggaaccacacaacuaagcucugugaauaucugcacuuuccggggcgacgucacccagauugguuccacaaagcauuggaccaugaaccucgcgucaccaaauuggaacaauuacgauccgacggaggaaacucccgccccucuggggacaccagacuuugugggaaaaauccacggcaugcuuacccagacuacacaggagaacggcagcacccgcgcacaucgagcuacgguauauguugggggagccaauuucacccccaagcuggguaaggugcaauuugaaacagacacuggcgaugacuuggcuaucagacagaacaccaaauucacaccugucggggugauucagaguucugaucaccacagggacgagccacaacaguggcggcuccccaauuacuccggagccaacacuuuuaauguccaucuggcaccggccguggcuccuaacuucccaggcgaacaguuacuguuuuuccguagcacccuccccgguugugggggccacccuaacauggaucuugacugccuguugccccaggaguggguucaacauuuuuaccaggaggcggcaccagcccagucggauguggcucuacugcgcuucguaaauccugacacaucuagaguccucuuugaauguaagcugcacaaauccggauaugugaccguugcccacacuggccaguacgaucuugugcugcccucaaacggguauuucagguuugacaguugggucaaucaauucuacacguuggcaccaaugggaaacgguacaggccggcgacgcuga

SEQ ID NO: 21587 - RNA, 1614 nt, Artificial Sequence
  derived and/or modified sequence opt3 from VP1__Norovirus_and/or_Norovirus-like__KX514199
augaagauggccagcuccgacgcuaaccccucugauggcucagcagccaaucuggugccugaggucaacaaugaaguuauggcgcucgagccagugguaggggcugccaucguggcaccggucgccggacagcaaaacgugauugaccccuggauaagaaauaacuucguucaggcuccugguggcgaauuuaccgugaguccaaggaaugcacccggggagauccuuuggagcgccccucugggaccagauuugaaccccuacuuaucccaccuggcucggauguauaauggcuacgccgguggguucgaaguccaggugauucuagcgggaaacgcauuuacagccggcaaaaucauuuucgcugccguaccuccaacuuuuccgacggagggccucucucccucgcagguuaccauguucccucauaucauaguggacguccgccaacuggagccagugcuuaucccccugccugaugugcgaaauaacuuuuaucacuacaaucagucaaacgacagcacaauuaaguugaucgcaaugcucuauacuccacugcgugcuaauaaccccggggaugacgucuucaccguuaguugcagagugcugacaaggccguccccugauuuugacuucauuuuucucguacccccaaccguggaaucucggacuaaaccuuucagcguccccaucuuaacagugggagagaugaccaacucccgcuuuccaauaaaucuggaaagacuuuucacgggucccucaagugccaacguugugcagccucagaaugggagguguacuauugauggcgaguugcugggaaccacacaacuaagcucugucaacaucugcacuuuccggggcgacgugacccauauugguuccacacaccauuggaccaugaaucucgcgucaccaaacuggaauaacuacgauccgacggaggaaacucccgccccucuggggacaccagacuuuguaggaaagauccacggcaugcuuacccagacuacacagggcagcgggaguacccgcgcacaccgagcuacgguuuaugugggaucugccgaguucacccccaaacuggguaagguccaguuuaagacagaaacugaccaugauuugaccaucagacaaaauacaaaauucacuccugugggcgucauucaggaguccgaccaccauagggaugaaccacagcaauggcggcuccccaacuacagcggggcuaauaccuuuaacgugcaccuggccccggcaguugccccuaauuucccaggagagcaguuacuguuuuuccguucgacacuccccggcuguggugggcacccuaacauggaccuugauugccuguugccccaggagugggugcuacauuuuuaccaggaagcugcgccagcacaaucugacguagcccugcuccgcuucgucaauccugauaccuccagagugcuguuugaguguaaacuucacaagucaggcuauguuacuguggcucauacgggacaguacgaccuggucuugcccaguaacggcuauuucagguuugauagcugggugaaccaguucuacacacucgccccaauggggaauggaaccggucggcgacgcuga

SEQ ID NO: 21588 - RNA, 1614 nt, Artificial Sequence
  derived and/or modified sequence opt3 from VP1__Norovirus_and/or_Norovirus-like__KX514176
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaacuuuuccgacggagggccucucucccucgcagguaaccauguucccucauaucauaguugacgugcgccaacuggagccaguccuuaucccccugccugaugugcgaaauaacuuuuaucacuacaaucagucaaacgacagcacaauuaaguugaucgcuaugcucuauacuccacugcgugccaauaaccccggggaugacguguucaccgucaguugcagaguucugacaaggccguccccugauuuugacuucauuuuucucgugcccccaaccguagaaucucggacuaaaccuuucagcgugcccaucuuaacagucggagagaugaccaacucccgcuuuccagugaaucuggaaagacuuuucacgggucccucaagugcgaacguugugcagccucagaaugggagguguacuauagauggcgaguugcugggaaccacacaacuaagcucugucaacauuugcacuuuccggggcgacgugacccgcaucgguacaacccagcauuggacgaugaaucucgccuccccaaacuggaauaacuacgauccgacugaggaaacacccgcaccucuggggaccccagacuuuguaggaaagauucacggcaugcuuacucagacaacccagggcucagggagcacgcgagcucauagagccaccguuuaugugggaagugcugaguucacacccaaacuggguaaggucagguuugaaacugacaccgaggaugacuuggugauccggcaaaauacaaaguucacuccugucggcgugauccagucuuccgaacaccaccgugaugagccacagcaauggcgccuccccaacuacagcggggccaauaccuuuaacguucaucuggcaccggccguggcuccuaauuucccaggagagcaguuacuguuuuucagaucgacacuccccggcuguggugggcacccuaacauggaccuugauugccuguugccccaggaauggguacagcauuuuuaccaagaggcggcaccagcccagucugacgucgcucuacugagguucgugaauccugauaccucccggguucucuuugaauguaaacugcacaagucaggcuaugugacugucgcccacacgggacaguacgaccuugugcugcccaguaacggcuauuuccgauuugauagcuggguaaaccaguucuacacauuggcaccaauggggaauggaaccggucgcagaagguga

SEQ ID NO: 21589 - RNA, 1614 nt, Artificial Sequence
  derived and/or modified sequence opt3 from VP1__Norovirus_and/or_Norovirus-like__KX514360
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaacguuuccgaccgagggccucucucccucgcagguaacaauguucccucauaucauaguugacgugcgccaacuggagccaguccuuaucccccugccugaugugcgaaauaacuuuuaucacuacaaucagucaaacgacagcacuauuaaguugaucgcaaugcucuauaccccacugcgugcuaauaaccccggggaugacguguucacagucaguugcagaguucugaccaggccguccccugauuuugacuucauuuuucucgugcccccaacuguagaaucucggacaaaaccuuucagcgugcccaucuuaaccgucggagagaugacgaacucccgcuuuccaauaaaucuggaaagacuuuucacuggucccucaagugccaacgugguucagccucagaaugggagguguaccauugauggcgaguugcugggaacaacucaacuaagcucugugaacaucugcaccuuccggggcgacgucacacagauugguuccaccaagcauuggacgaugaaucucgcgucaccaaacuggaauaacuacgauccgacugaggaaacacccgccccucuggggaccccagacuuugugggaaaaauccacggcaugcuuacucagacaacccaggagaauggcagcacgcgcgcacaucgagcuaccguauauguugggggagccaacuucacacccaagcuggguaaggugcaauuugaaacugacaccggcgaugacuuggcuaucagacagaauacaaaauucacuccugucggggugauucagaguucugaucaccacagggacgagccacaacaguggcggcuccccaacuacuccggagccaauaccuuuaacguccaucuggcaccggccguggcuccuaauuucccaggcgaacaguuacuguuuuuccguagcacacuccccgguugugggggccacccuaacauggaucuugacugccuguugccccaggaguggguucaacauuuuuaccaggaggcggcaccagcccagucggauguggcucuacugcgcuucguaaacccugacaccucuagaguccucuuugaauguaagcugcacaaauccggauaugugacuguugcccacacgggccaguacgaucuugugcugcccucaaauggguauuucagguuugacaguugggucaaccaauucuacacauuggcaccaaugggaaaugguaccggccggcgacgcuga

SEQ ID NO: 21590 - RNA, 1614 nt, Artificial Sequence
  derived and/or modified sequence opt3 from VP1__Norovirus_and/or_Norovirus-like__KX514347
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaugacguguucacugucagcugcagaguucugaccaggcccaguccggauuuugacuucauuuuucucgugccucccacaguagaaucccggucuaaaccauucagcgugccugucuuaaccguggaggaaaugacuaacucccgcuuucccgccacacuggauaaacuuuucaccggaccaucaaguacguucguugugcagccccagaaugguagauguaugaucgacggcgucuugcuggggacuacccaacuaagcccugugaacauaugcacauuuaggggagauguaacucagucuggcaauaccaagauuuacacaaugaaccucgcauccccaaauuggaacaauuaugacccgaccgaggagauccccgcuccucuggguacgccagacuucguugggaagauucauggaaugcuuacucagacaacccagggcucaggcagcacucgggcccaccgcgcuacaguguacgucgggggagccgaauuuacccccaagcuggguaaagugcgauucgagacggauaccgaagacgauuuggucaucagacaaaacacaaaguuuacuccugugggcguuauccagaguucugagcaucacagggacgaaccacagcaauggcggcuccccaauuacuccggggcaaacaccuucaaugugcaccuggccccggcuguagcgccuaacuuuccaggagagcaguuacuguucuuucguagcacacuccccggcuguggugggcauccuaauauggaucuugacugccuguugccccaggaguggguccagcacuucuaucaagaagcagccccagcucagucggauguggcccuacugcgcuuuguuaacccugacacuucuagaguccucuucgaguguaaacugcauaaguccggcuacgugaccguggcacacacaggacagcacgaucuuguacugcccucaaacggcuauuuuagguucgacaguugggugaaucaguucuacaccuuggccccaauggggaacggaacuggucggcgacgcuga

SEQ ID NO: 21591 - RNA, 1614 nt, Artificial Sequence
  derived and/or modified sequence opt3 from VP1__Norovirus_and/or_Norovirus-like__AB684675
augaagauggccagcuccgacgcuaaccccucugauggcucagcagccaaucuggugccugaggucaacaaugaaguuauggcgcucgagccagugguaggggcugccaucgcagccccgguggcuggacagcaaaacauuauagaccccuggaucagaaauaacuucguccaggcaccugguggcgaauuuaccgugaguccaaggaaugcccccggggagauucuuuggagcgcuccucugggaccagauuugaaccccuacuuaucccaccugucucggauguauaauggcuacgccgguggguucgaaguucaggugauccuagcgggaaacgcauuuacagccggcaaagucauuuucgcugccgugccuccaaauuuuccgacugagggccucucgcccucacagguaacgauguucccucauaucauaguugacgugcgccaacuggagccaguccuuaucccccugccugaugugcgaaacaauuuuuaucacuacaaccaggcacaugacagcaccuugaagcucauugcuaugcuguauacaccacugcgugccaauaacgcgggggaugacguguucacugucaguugcagaguucucaccaggcccuccccggauuuugacuucaucuuuuuagugccucccacaguagaaucucggaccaaaccauucacugugccuauucugacagucgaggaaaugagcaacucccgcuuucccaucccacuugagaaguuguacaccggacccucaagugccuucgugguucagccucagaaugguagauguacgacugauggcgugcugcuagggaccacacaacucagcgcagucaacauaugcaauuuccugggagacgugacuaggguaggcaccucucacgauuauacaaugaaccuuguuucccagaauugggacaacuacgacccaaccgaggaaauuccggcuccccuggguacgccugauuuuguggggaaaauccagggauugcucacucagacaacccgggccgaccgcucaacuccagcucauaaggccacagucagcaccggcagugugcacuucacgcccaagcugggcucuguccaauuuaccacagauacuaauaacgacuuccagaccgggcagaauacaaaauuuacuccugugggaguuauucaagauuccgaccaccaucagaacgagccacagcaguggguguuacccaauuacagcgguaccacaggccacaacguacaucuggcaccggccgucgcuccuaccuucccaggggaacaacuccuguuuuuccgagugacuaugcccggauguucgggcuauccuaauaugaaccuugauugcuugcuaccccaggaguggguucugcacuuuuaccaggaagcggcaccagcccagucugacguggcucuccugagauucgucaauccugauacggguagggugcuuuuugaguguaagcugcacaaauccggguauaucacaguagcccauaccggccccuacgacuuggugaucccaccgaacggauauuuccgguuugauucauggguuaaccaauucuacacucucgcaccuaugggcaaugggaccggacgucgcagauga

SEQ ID NO: 21592 - RNA, 1614 nt, Artificial Sequence
  derived and/or modified sequence opt3 from VP1__Norovirus_and/or_Norovirus-like__KX514369
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaacuuuuccgacggagggccucucucccucgcagguaaccauguucccucauaucauaguugacgugcgccaacuggagccaguccuuaucccccugccugaugugcgaaauaacuuuuaucacuacaaucagucaaacgacagcacaauuaaguugaucgcuaugcucuauacuccacugcgugccaauaaccccggggaugacguguucaccgucaguugcagaguucugacaaggccguccccugauuuugacuucauuuuucucgugcccccaaccguagaaucucggacuaaaccuuucagcgugcccaucuuaacagucggagagaugaccaacucccgcuuuccagugaaucuggaaagacuuuucacgggucccucaagugcgaacguugugcagccucagaaugggagguguacuauagauggcgaguugcugggaaccacacaacuaagcucugucaacauuugcacuuuccggggcgacgugacccagaucggugccacacgccauuggaccaugaaucucgcauccccaaacuggaauaacuacgauccgacggaggaaacucccgcuccucuggggacaccagacuuuguaggaaagauucacggcaugcuuacccagacuacacagggcucagggagcacccgagcccauagagcuacgguuuaugugggaggugccgaguucacccccaaacugggcaaggucagguuugaaacagacacugaggaugacuuggugauccggcaaaauaccaaguucacaccugucggggugauccagaguucugaacaccaccgugaugagccacagcaauggcgccuccccaacuacuccggagcaaauacuuuuaacguucaucuggccccggcuguggcgccuaauuucccaggcgagcaguuacuguuuuucagaagcacccuccccgguugugggggccacccuaacauggaccuugauugccuguugccccaggaauggguacagcauuuuuaccaagaggcagccccagcucagucggacgucgcccuacugagguucgugaauccugauacaucucggguucucuuugaauguaaacugcacaaguccggauaugugaccgucgcacacacuggccaguacgaccuugugcugcccucaaacggguauuuccgauuugauaguuggguaaaccaguucuacacguuggccccaaugggaaaugguacaggccgcagaagguga

SEQ ID NO: 21593 - RNA, 1614 nt, Artificial Sequence
  derived and/or modified sequence opt3 from VP1__Norovirus_and/or_Norovirus-like__KX514310
augaagauggccagcaacgacaccaaucccuccgauggcucugcugcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacucaacaauuaaguugaucgcaaugcucuauacuccacugcgugcuaacaaugccggggaugacguguucaccgucagcugcagaguucugacaaggcccaguccggauuuugacuucauuuuucucgugccucccaccguagaaucccggucuaaaccauucagcgugccugucuuaacuguggaggaaaugacaaacucccgcuuucccgcgacccuggauaaacuuuucacgggaccaucaaguacuuucguugugcagccccagaaugguagauguaugaucgacggcgucuugcuggggaccacacaacuaagcccugugaacauaugcacuuuuaggggagauguaacccauccacgggacucuaagauuuacacaaugaaucucgccuccccgaacuggaauaacuaugaccccaccgaggagaucccugcaccacugggcacgcccgauuucguugguaagauucacgggaugcuuacucagacaacccaggaaaauggaucaacucgcgcucaucgagccacaguguacgucggcggcgcuaacuuuaccccuaagcuggggaaagugcaguucgagacggacaccggagaugacuuggccaucagacaaaauacaaaguuuacuccagucggugugauccagagcagugaucaccacagggacgaaccccagcaauggcggcucccgaacuacucuggcgcaaauaccuucaacguucaucuggccccugcuguggcgccaacauuucccggggagcaguuacuguucuuucguuccacuauuccuggauguggcggucaccccaauaugaaccucgauugccuucugccacaggaauggguacagcauuucuaucaagaggcagccccugcucagagcgacgucgccuugcuacgcuuugugaaccccgauaccucgagaguucuguucgaguguaaacuccacaagucuggguacgugacagucgcacacaccggccaguaugaccuggugcuuccauccaauggauacuuuagguucgauucauggguaaaccaguucuauacucuggccccgaugggcaaugggacgggacggcgacgcuga

SEQ ID NO: 21594 - RNA, 1614 nt, Artificial Sequence
  derived and/or modified sequence opt3 from VP1__Norovirus_and/or_Norovirus-like__KX514185
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaacuuuuccgacggagggccucucucccucgcagguaaccauguucccucauaucauaguugacgugcgccaacuggagccaguccuuaucccccugccugaugugcgaaauaacuuuuaucacuacaaucagucaaacgacagcacaauuaaguugaucgcuaugcucuauacuccacugcgugccaauaaccccggggaugacguguucaccgucaguugcagaguucugacaaggccguccccugauuuugacuucauuuuucucgugcccccaaccguagaaucucggacuaaaccuuucagcgugcccaucuuaacagucggagagaugaccaacucccgcuuuccagugaaucuggaaagacuuuucacgggucccucaagugcgaacguugugcagccucagaaugggagguguacuauagauggcggauugcugggcaccacacaacuaagcucugucaacauuugcacuuuccggggugacgugacccauaucgggacaacccgccacuggacgaugaaucucgccuccccaaacuggaauaacuacgauccgacugaggagacacccgcaccucugggaaccccagacuuuguaggcaagauucauggcaugcuuacucagacaacccaggggucaggaagcacgcgagcucacagagccaccguuuauguggguagugcugaguucacacccaaacugggcaaggucagguuugaaacugacaccgaagaugacuuggugauccggcagaauacaaaguucacuccugucggggugauccaaucuuccgagcaccaucgugaugaaccacagcaguggcgccuccccaacuacagcggagccaauaccuuuaacguucaccuggcaccggccguggcuccuaauuucccaggcgagcaauuacuguuuuucagaucgacacuccccgguugugggggccauccuaacauggaccuugauugccuguugccccaggaguggguacagcacuuuuaccaggaagcggcaccagcccaaucugacgucgcucuacugagguucgugaauccugauaccucccggguucucuuugaguguaaacugcacaagucaggauaugugacugucgcccauacgggccaguacgaccuugugcugcccaguaacggguauuuccgauuugauagcuggguaaaccaguucuacacauuggcaccaaugggaaaugguaccggccgcagaagguga

SEQ ID NO: 21595 - RNA, 1614 nt, Artificial Sequence
  derived and/or modified sequence opt3 from VP1__Norovirus_and/or_Norovirus-like__KX514181
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaacuuuuccgacggagggccucucucccucgcagguaaccauguucccucauaucauaguugacgugcgccaacuggagccaguccuuaucccccugccugaugugcgaaauaacuuuuaucacuacaaucagucaaacgacagcacaauuaaguugaucgcuaugcucuauacuccacugcgugccaauaaccccggggaugacguguucaccgucaguugcagaguucugacaaggccguccccugauuuugacuucauuuuucucgugcccccaaccguagaaucucggacuaaacaguucagcgugccuaucuuaacagucggagagaugaccaacucccgcuuucccgugaaucuggaaagacuuuucacggguccaucaagugcgaacguugugcagccccaaaaugggagguguacuauagauggcgaguugcugggaaccacacagcuaagcucugucaacauuugcacuuuccggggcgacgugacccauaucgguacaacccgccacuggacgaugaaucucgccuccccuaacuggaauaacuacgauccaacugaggaaacaccggcaccccuggggaccccugacuuuguaggaaagauucauggcaugcuuacucagacaacccagggcucagggagcacgcgagcucacagagccaccguuuaugugggaagugcugaguucacaccaaaacuggguaaggucagguuugaaacugacaccgaggaugacuuggugauccggcaaaauacaaaguucacucccgucggcgugauccagucuuccgaacaccaucgugaugagccucagcaauggcgccucccaaacuacagcggggccaauaccuuuaacguucaccuggcacccgccguggcuccgaauuucccuggagagcaguuacuguuuuucagaucgacacucccaggcuguggugggcaucccaacauggaccuugauugccuguugccucaggaauggguacagcacuuuuaccaagaggcggcacccgcccagucugacgucgcucuacugagguucgugaauccagauaccucccggguucucuuugaauguaaacugcacaagucaggcuaugugacugucgcccauacgggacaguacgaccuugugcugccuaguaacggcuauuuccgauuugauagcuggguaaaccaguucuacacauuggcacccauggggaauggaaccggucgcagaagguga

SEQ ID NO: 21596 - RNA, 1614 nt, Artificial Sequence
  derived and/or modified sequence opt3 from VP1__Norovirus_and/or_Norovirus-like__KF712493
augaagauggccagcuccgacgcuaaccccucugauggcucaaccgcaaaucuggugccugaggccaacaaugaagucauggcgcucgagccaguugugggggcugccaucgcagccccgguagcuggacagcaaaacgugauugaccccuggauaagaaauaacuucguccaggcaccugguggcgaauuuacagugaguccaaggaaugcccccggggagguucuuuggagcgcuccucugggaccagauuugaaccccuacuuaucccaccuggcccggauguauaauggcuacgcggguggguucgaagugcaggucauccuagcaggaaacgccuuugcugccggcaaaauuaucuucgcagcugugccuccaaauuuuccgacugagggccucucucccucgcagguaacgauguucccucaucugauuguugacgugcgccaacuugagccagucaugaucccccugccugauauacgaaacaauuuuuaucacuacaaccagucaaaugacccaaccaucaaguugauugccaugcucuauacaccccugcgugcgaacaacgugggggaugacguguucacugucagcugcagaguucugaccaggccgaguccugauuuugacuucaucuuucucgugcccccaacaguagaauccaaaaccaauccuuucucugugcccauuuuaacuaucgaggaaaugacaaacagccgguuuccaauaccccuggagaaacuuuucaccggaccuuccucagccuuggucgugcagccacagaauggucgcuguacgacugauggcguucugcuagggaccacacaacucaguccggugaacauuugcacuuucagaggagacgucacccauacaaccaagacgcacacuuaccagaugaaucuggcagcucagaacuggaauagcuaugaucccacagaggaaaucccugccccacuuggcacccccgacuuuguggguaagauucaggggguacugacucaaacaaccaagggaaacggcucuacgagggcucauaaagccaccguuuacacaggcgggguggaguucacuccuaaguugggacggauccagcucuuuaccgacacagauaaugaccuggaagcaaaccagaauacuaaauucaccccagucggugugauccaagauggcgacacacaccagaacgagccccagcagugggucuuaccguccuacucagggcgcaauaaccacaaugugcaucuggccccugcuguugcgccaaccuuucccggagaacaacuccuuuucuuucgaagcacuaugccuggcuguagugguuaucccaacaugaaccuggauugcuugcuaccacaggagugggugcaguacuucuaucaggaggcagccccugcucaaucugacguagcccugcucagauuugucaaucccgauacggggagggugcuguucgaauguaaacuucacaaguccggcuacguuacaguggcacauaccggacaccacgaccuguuuauuccaccgaacggcuauuuccgguuugauagcugggucucgccuuucuacacuuuggcccccauggggaauggaaccggucgucgcagauga

SEQ ID NO: 21597 - RNA, 1614 nt, Artificial Sequence
  derived and/or modified sequence opt3 from VP1__Norovirus_and/or_Norovirus-like__FJ411169
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacucaacaauuaaguugaucgcaaugcucuauacuccacugcgugcuaacaaugccggggcggauguguucaccgucagcagaaggguucugacacggcccaguccggacuuugauuucaucuuuuccgugccucccaccguagaaucucgcacuaaaccauucacagugccuauucucaccgucgaggaaaugagcaacuccagauuucccauaccauuagagaagcuguacacgggacccucaagugccuucgugguucagccucagaaugguaggugcacuaccgacggcgugcuuuuggggacaacucaacugagcgcagucaacauuuguaccuuccggggagaugugacacauaucgcuggcucucacgacuauaccaugaaucuagccucccagaacuggaauaacuacgauccaacggaggaaauuccggcuccccucgguacuccugacuuuguagggaaaauccagggaaugcugacacagaccacucgcgaggacggcucaacacgagcccauaaggcaaccguuagcacgggcagugugcacuucaccccaaaacuugggucuguccaauacacaacugauaccaauaacgacuuucagacaggacagaauacuaaguucacccccgugggugucauccaagauggcaacaaucaccagaacgaaccucagcagugggugcugccaaauuauuccgggagaacaggacauaacguucacuuggcccccgcuguggcgccgaccuuuccuggcgagcaacuccuguucuuuaggagcacuaugccagguugcucgggguaccccaacaugaauuuagacugucugcucccucaggaauggguacagcauuucuaucaggaggcagcccccgcucaaucugaugucgcccuucugcgguuugugaacccagacacgggccguguuuuguucgagugcaagcuacacaaauccggauacgugacagucgcacacaccggcccucaugaucuggugauucccccaaauggguauuuucgcuucgacucauggguaaaccaguuuuacacucucgccccgaugggaaauggugcuggcagaaggcgguga

SEQ ID NO: 21598 - RNA, 1614 nt, Artificial Sequence
  derived and/or modified sequence opt3 from VP1__Norovirus_and/or_Norovirus-like__AF427121
augaagauggccagcaacgacgcuaaucccuccgauggcucuaccgcaaaccuggugccugaggucaauaacgaaguuaugacacucgagccagugguaggggccgcgaucgcugccccgguggcaggacagcaaaaugucauugaccccuggauagguaacaauaucgugcaggccccuggcggggaguucacuguuucaccaagaaacgcucccggagaaauucuuuggagugcaccucugggcccagauuugaaucccuacuuaagccaccuggccaggauguauaacgguuacgcugggggauuugaagugcaggucauccuagccggcaaugcguucacggcaggcaaaauuaucuuugccgcugugccuccaaacuucccgaccgaggggcucucccccucucagguaacaguuuuuccucauauaaucguggacguccggcaacuggagccagugcuuauuccccugccugaugugcgcaauaacuuccaccauuauaaucagucgaacgacucaacuaucaaguugauugccaugcucuacaccccacugcgagcaaacaaugcuggagaugacgucuuuacaguuagcugccgugugcugaccagacccaguccggauuucgacuuuaucuuccucguaccucccacuauagaauccaggacaaaaccauuuaccgugccuauuuuaacggucgaggaaaugucuaacagccgguuccccaucccacuggagaaacuuuauacuggucccuccucagccuuugugguucagccucagaauggccgcuguaccacagaugggguguugcugggaacuacccaacuaagugcggucaacauuugcacauucagaggcgacgugacccacaucgccgguagccaugauuacacgaugaaucucgcaucucagaacuggaauaacuaugacccaacugaggaaaucccggcuccccuggggacaccugacuucguaggaaagauucagggcguucuuacccagacuacaagggaggauggcuccacccgggcccacaaggcuacggugucaaccgggagcguccacuuuacaccaaagcugggaagugugcaauacacuaccgacacaucuaaugauuuccagacuggucagaacaccaaauuuacacccgucggcgugauacaagacgggaauaaccaucagaaugaaccucagcaguggguuuugccaaacuacuccggacgcaccggccacaaugugcaucucgcccccgcaguagccccgacuuucccuggugagcaacuguuauuuuuccgaagcacgaugccaggguguucgggcuaucccaacaugaaccuggauugccuccuuccucaggaauggguccagcacuuuuaccaggaggcugcgcccgcacaaucugacguggcccuguugagauucguuaauuccgauacaggaagggugcuauuugaguguaagcugcacaaaucaggcuaugucaccguggcucauacugggccacacgaccucguaaucccucccaacggauacuuccgguuugauaguugggugaaucaguucuauacccuggccccaauggguaacggcgcagggcgucgcagauga

SEQ ID NO: 21599 - RNA, 1614 nt, Artificial Sequence
  derived and/or modified sequence opt3 from VP1__Norovirus_and/or_Norovirus-like__KF429787
augaagauggccagcaacgacgcuacccccuccgaugggucuucagcaaaucuggugccugaggccaacaaugaagucauggcgcucgagccaguugcuggggccgcaaucgccgcuccgguggcaggacagcaaaacguaauugaccccuggauaagaaauaacuucgugcaggccccugguggcgaauuuacagucaguccaaggaaugcucccggggagauccuuuggagcgccucccugggaccugauuugaacccauacuuaucucaccugucgcggauguauaauggcuacgcggguucauucgaagugcagguuauucuagcagggaacgccuuuacugcuggaaaaaucauuuucgccgcagugcccccuaauuuucgcacggagggccucagcccaagucagaucaccauguucccgcauauaaucacagacguccgacaacuggagcccgugcuuauuccucugccagauauccguaacaauuuuuaucacuacaaccaguccaaugaccccacuauuaaguugaucgcuaugcucuauaccccucugagagccaacaacgcgggcgaugacguauucacaguuucuugcagggugcugacccggccaagccccgauuuugacuucauauuucucgucccgccuacuguggaaucccgcacaaaacccuucucagugccagucuuaaccguugaggaaaugacgaauaguagauuuccuauuccccuggagaaacuuuucacugggccaagcucugccuucgugguacagccccagaacggaagguguaccacagaugguguguugcugggcacuacccaacuauccccugucaauaucugcacauuucggggcgacgugacccgcauuggaaacucacgagaguacagaaugaaucucgcaagccugaacuggaauaacuaugauccaacggaagagaucccggcuccccuuggcacuccugacuucgccgguaagauccaggggguucugacacagaccacuaggcaugacggaaguacacggggccacaaggcuaccguguacacgggcucugccggguuuaccccaaaguugggauccguccaguucagcacagauacugacaaugaucucgaagcaaaccaaaauacccguuuuacacccguggguguaauucaggacggcaacgcccaucagggggagccucaacaguggguucugccaaauuacgcuggacgcgauggccacaacgugcacuuagcgcccgcagucgccccgacuuucccuggugaacagcugcucuuuuucagaucgaccaugccaggguguucuggcuaucccaauaugaaccuugacugccuguugccucaggagugggugcaacauuuuuaccaggaguccgcucccgcccagucagaugucgcacuacugagguucgugaacccagacacaggacggguucucuuugaauguaaacugcacaagaguggcuaugugaccguagcccauacugggccucacgaucuugucauacccccaaauggauacuuccgauuugacagcugggugaaccaguucuauacgcuggcuccgauggguaauggcgccgggcgcagaagguga

SEQ ID NO: 21600 - RNA, 1614 nt, Artificial Sequence
  derived and/or modified sequence opt3 from VP1__Norovirus_and/or_Norovirus-like__AB933728
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcaaucccuccaaacuuuccgacugagggccucucccccucucaggugacgauguucccucauauaguaguugacgugcgccaacuggagccaguccuuaucccccugccugaugugcgaaauaacuuuuaucacuacaaucagaccaaggaaucgacaauuaaauugguggcuaugcucuauacuccacugcgugccaacaacgcgggggacgaugucuucaccguuucaugcagagugcugacaaggcccagcccggacuuugauuucaucuuucucguaccucccaguguggagucccggaccaagccauucacugucccuauuuuaacaguggaagagaugaccaauucucgcuuucccaucccacuggagagacuuuucacgggacccagcuccgccuucguugugcagccucagaacgguagguguacuaccgacggcgucuugcuggggacaacucaacuaucaccagugaauauaugcaccuuucggggagauguaacacgcguuaguaccacgcauguguacgaaaugaaccucgcaagccagaauuggaacaauuaugacccgacugaggaaguccccgcuccucugggcacaccagauuucguggguaaaauucaggggguccuuacccagacuacacgaaccgacggaucuacgagagcccacaaggcuaccguguccacaggcgccgcagacuuuacucccaagcugggcucaaucagguucgagaccacaacuaaccgggauuuggaaacccaucaaaauacaaaauuuaccccuguuggggugauucaggacggagauaaccaccagaaugagccacaacaguggcgucuccccgguuacgccggccgcgacgcucacaacguacaucuggcgccggcagucgccccuacuuucccaggggagcaguuacuguuuuucagaagcacgaugcccggauguaguggcuacccuaauaugaaccucgauugccuucugccccaggaaugggugcaacacuuuuaucaggaggcugccccagcacagucugacguugccuugcuaagguucgugaauccugauacaggucggguccuguuugaauguaagcuccauaaauccggguaccugaccguggcucacacuggccccuaugaccuuguaaucccaccgaacggauacuuccgauuugauagcugggugaaccaguucuauacccuggccccuaugggcaaugggacaggacgcagaagguga

SEQ ID NO: 21601 - RNA, 1614 nt, Artificial Sequence
  derived and/or modified sequence opt3 from VP1__Norovirus_and/or_Norovirus-like__KX514346
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaacuuuuccgacggagggccucucccccucucagguaaccauguucccucauaucauaguugacgugcgccaacuggagccaguccuuaucccccugccugaugugcgaaacaauuuuuaucacuacaaccagucgaaugacucaacaauuaaguugaucgcuaugcucuauacuccacugcgugccaacaaccccggggaugacguguucaccgucagcugcagaguucugacaaggccgaguccugauuuugacuucauuuuucucgugcccccaaccguagaaucccggacuaaaccuuucucugugcccaucuuaacagucggagagaugaccaauagccgcuuuccagugaaccuggaaagacuuuucacgggucccuccucagcgaauguugugcagccucagaacgggagguguacuauagauggggaguugcugggaaccacacaacuaaguagcgucaauauuugcacuuuccggggcgacgugacccagaucgguucuacaaagcauuggaccaugaaccucgccuccccaaauuggaacaauuacgauccgacggaggaaacucccgcaccucuggggacaccagacuuuguaggaaaaauucacggcaugcuuacccagacuacacaggagaacggcucaacccgcgcucaucgagccacgguuuaugugggcggaagcaauuucacccccaagcuggguaaggucccuuuugaaacagacacuggcgaugacuuggcuaucagacaaaacaccaaauucacaccagugggggucauccagaguucuggacaccacagggaugagccccagcaauggcggcucccgaauuacuccggcgccaacacuuuuaaugugcaucuggccccugcaguugcuccaaacuuccccggugaacaguuacuguuuuuccguagcacccucccuggguguggcggacaccccaacauggaccuugauugccuguugccacaggagugggugcagcauuuuuaccaagaggcggccccugcacagucggacguagcucuacugcgcuucgucaaucccgauacaucuagagugcucuuugaauguaagcugcacaaauccggcuauguuaccguggcccacacugggcaguacgaccuuguccugccaucaaacggauauuucagguuugauaguugggugaaucaguucuacacguuggcaccgauggguaacggcacagggcggcgacgcuga

SEQ ID NO: 21602 - RNA, 1614 nt, Artificial Sequence
  derived and/or modified sequence opt3 from VP1__Norovirus_and/or_Norovirus-like__KX514249
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaacuuuuccgacggagggccucucucccucgcagguaaccauguucccucauaucauaguugacgugcgccaacuggagccaguccuuaucccccugccugaugugcgaaauaacuuuuaucacuacaaucagucaaacgacagcacaauuaaguugaucgcuaugcucuauacuccacugcgugccaauaaccccggggaugacguguucaccgucaguugcagaguucugacaaggccguccccugauuuugaccucauuuucuuagugcccccaaccguagaaucucggacuaaaccuuuuagcgugcccauccugacagucggagagaugaccaacucccgcuucccaauaaaucuugaagguuuguuuacgggccccucaagugcgaacgugguucagccucagaaugggagauguacuauugauggagagcugcuaggcaccacacaacucagcucugugaacaucugcacuuucaggggugacgucacccauauuggguccacacaccauuggaccaugaaucuggccucaccaaacuggaauaacuacgauccgacggaggaaacucccgcaccucuuggaacaccagacuucgugggcaagauccacggcaugcugacccagacuacacaggggagcggaaguacccgggcucaccgcgccacgguauauguugguggcgcugaguuuacccccaaauuggggaaggugcaguucaagacagaaacuaaucaugaccucucuauccgacaaaacaccaaauuuacaccugucggagugauucaggaguccgaucaccauagagacgaaccacagcaauggaggcugcccaauuacagcggcgccaacacuuucaauguccacuuagcaccggccguggcuccuaacuuuccaggugagcagcuucucuucuuucggucgacccuucccggguguggcggacacccuaauauggaucuggacugcuugcuaccccaggaguggguucagcauuucuaccaagaagcggcaccagcccagucugauguggcucugcuccguuuuguaaacccugacacaucccgcguccuguucgaguguaagcugcacaaaucaggcuaugugaccguugcccauacugggcaguacgaucugguguugcccaguaacggauauuuuagauucgacagcugggucaaucaguuuuacacgcucgcaccaauggguaacggcacagggaggcggcgauga

SEQ ID NO: 21603 - RNA, 1614 nt, Artificial Sequence
  derived and/or modified sequence opt3 from VP1__Norovirus_and/or_Norovirus-like__KF429760
augaagauggccagcaacgacgcuacccccuccgaugggucuucagcaaaucuggugccugaggucaacaaugaaguuauggcccucgagccaguggcgggggcugccaucgcagccccgguagcuggacagcaaaacgugauugaccccuggauaagaaauaacuucguccaggcaccugguggcgaauuuacagugaguccaaggaaugcccccggggagauccuuuggagcgcuucccugggaccugauuugaacccauacuuaucucaccugucgcggauguauaauggcuacgccgguucauucgaaguucaggugauucuagcggggaacgcauuuacugccggaaaaaucauuuucgcugccgugcccccuaauuuucgcacggagggccucagcccaagucagaucaccauguucccgcauauaaucacagacguccgacaacuggagcccguacuuauuccucugccagauauccguaacaauuuuuaucacuacaaccaguccaaugaccccacuauuaaguugaucgcaaugcucuauaccccucugagagcuaacaacgccggcgaugacguuuucacagugucuugcaggguccugacccggccaagccccgauuuugacuucauauuucucgugccgccuacuguggaaucccgcacaaaacccuucucagucccaguuuuaaccguggaggaaaugacgaauaguagauuuccuauuccccuggagaaacuuuucacugggccaagcucugcguucguagugcagccccagaacggaagguguaccacagauggugucuugcugggcacuacccaacuauccccugugaauaucugcacauuucggggcgacguuacccgcauuggaaacucacgagaguacagaaugaaucucgccagccugaacuggaauaacuaugauccaacggaagagaucccggcaccccuuggcacuccugacuucgcugguaagauccagggggugcugacacagaccacuaggcaugacggaaguacacggggccacaaggccaccgucuacacgggcucugcuggguuuaccccaaaguugggauccgugcaguucagcacagauacugacaaugaucucgaagccaaccaaaauacccguuuuacacccguagguguuauucaggacggcaacgcacaucagggggagccucaacagugggugcugccaaauuacgccggacgcgauggccacaacguccacuuagcucccgcgguggcaccgacuuucccuggugaacagcugcucuuuuucagaucgaccaugccaggguguucuggcuaucccaauaugaaccuugacugccuguugccucaggaguggguccaacauuuuuaccaggaguccgcccccgcucagucagauguggcccuacugagguucguuaacccagacacaggacgggugcucuuugaauguaaacugcacaagaguggcuauguaaccgucgcacauacugggccucacgaucuugugauacccccaaauggauacuuccgauuugacagcuggguuaaccaguucuauacgcuggccccgauggguaauggcgcugggcgcagaagguga

SEQ ID NO: 21604 - RNA, 1614 nt, Artificial Sequence
  derived and/or modified sequence opt3 from VP1__Norovirus_and/or_Norovirus-like__AB303929
augaagauggccagcaacgacgcuaaucccuccgauggcucugcagccaaccuggugccugaggucaauaacgaaguuauggcgcucgagccagugguaggggcugccaucgcagccccgguggcuggacagcaaaauauuauagaccccuggaucagaaacaauuucguccaggcaccugguggcgaauuuaccgugucaccaaggaacgcccccggggagauucuuuggagugcuccucugggaccagauuugaaucccuacuuaagccaccugucccggauguauaacggcuacgccgguggguucgaaguucaggugauccuagcgggaaaugcauuuacagccggcaaagucauuuucgcugccgugccuccaaacuuuccgacugagggccucucucccucgcagguaacgauguucccucauaucauaguugacgugcgccaacuggagccaguccuuaucccccugccugaugugcgaaauaacuuuuaucacuacaaucaggcacaugacucaaccuugaagcucauugcuaugcuguauacaccacugcgugccaacaacgcgggggaugacguguucacugucagcugcagaguucucaccaggcccaguccggauuuugacuucaucuuuuuagugccucccacaguagaaucccggaccaaaccauucacugugccuguccugacaguggaggaaaugaccaauucucgcuuucccauuccacuugagaaguuguacacgggacccagcuccgccaucguugugcagccucagaacgguagauguacuaccgauggcguccugcuagggacaacucaacucucagcagugaauauaugcaccuucaggggagacguaacacacauugcuggcagucggaacuauaccaugaaucuggccagccagaacuggaauaacuacgauccaacggaggaaaucccggcuccccuugguacuccugacuucguugggaaaauucagggacuguugacacagaccacucgcgccgacggcucuacacgagcacauaaggccaccguguccacgggcucaguccacuuuaccccaaagcucgggagcgugcaauucaguacagauacugacaaugauuuucagcccggacagaacaccaaauucacaccugucggugugauccaagacggcgauagacaccagaaugagccacagcaguggguucugcccgacuuuucugggaggacuggacauaacgugcacuuagcuccggcgguagcaccuaccuucccaggcgaacaacugcucuuuuuccgguccacaaugcccggucguagcggguacccuaauaugaaccuugauugucuguugccccaggaguggguccuacauuuuuaucaggaaucggccccagcucagucugacguggcccugcuccgcuucguuaauccugauaccaacagagugcuguuugagugcaaacuucacaaguccggcuacaucacugucgcacacacgggacaucacgaccugauuuugcccccaaacggcuauuucagguuugauucaugggugaaucaauucuacacacucgccccgauggggaacggagcuggucggcgacgcuga

SEQ ID NO: 21605 - RNA, 1614 nt, Artificial Sequence
  derived and/or modified sequence opt3 from VP1__Norovirus_and/or_Norovirus-like__KX514363
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaacguuuccgaccgagggccucucucccucgcagguaacaauguucccucauaucauaguugacgugcgccaacuggagccaguccuuaucccccugccugaugugcgaaauaacuuuuaucacuacaaucagucaaacgacagcacuauuaaguugaucgcaaugcucuauaccccacugcgugcuaauaaccccggggaugacguguucacagucaguugcagaguucugaccaggccguccccugauuuugacuucauuuuucucgugcccccaacuguagaaucucggacaaaaccuuucagcgugcccaucuuaaccgucggagagaugacgaacucccgcuuuccaauaaaucuggaaagacuuuucacuggucccucaagugccaacgugguucagccucagaaugggagguguaccauugauggcgaguugcugggaacaacucaacuaagcucugugaacaucugcaccuuccggggcgacgucacacagauugguuccacccagcauuggacgaugaaucucgcgucaccaaacuggaauaacuacgauccgacugaggaaacacccgccccucuggggaccccagacuuugugggaaagauccacggcaugcuuacucagacaacccaagagaauggcagcacgcgcgcacaucgagcuaccguauauguugggggagccaacuucacacccaaacuggguaaggugagauuugaaacugacaccggcgaugacuuggcuaucaggcagaauacaaaguucacuccugucggggugauucagaguucugaucaccaccgggacgagccacaacaguggcgucuccccaacuacuccggagccaauaccuuuaacguccaucuggcaccggccguggcuccuaauuucccaggcgaacaguuacuguuuuuccgcagcacacuccccgguugugggggccacccuaacauggaucuugacugccuguugccccaggaguggguucaacauuuuuaccaggaggcggcaccagcccagucggauguggcucuacugagauucguaaacccugacaccucuaggguccucuuugaauguaaacugcacaaguccggauaugugacuguugcccacacgggccaguacgaucuugugcugcccucaaauggguauuuccgguuugacaguugggucaaccaauucuacacauuggcaccaaugggaaaugguaccggccgacgcagauga

SEQ ID NO: 21606 - RNA, 1614 nt, Artificial Sequence
  derived and/or modified sequence opt3 from VP1__Norovirus_and/or_Norovirus-like__KX514357
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucaucgaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaacuuuuccgacggagggccucucucccucgcagguaaccauguucccucauaucauaguugacgugcgccaacuggagccaguccuuaucccccugccugaugugcgaaauaacuuuuaucacuacaaucagucaaacgacagcacaauuaaguugaucgcuaugcucuauacuccacugcgugccaauaaccccggggaugacguguucaccgucaguugcagaguucugacaaggccguccccugauuuugacuucauuuuucucgugcccccaaccguagaaucucggacuaaaccuuucagcgugcccaucuuaacagucggagagaugaccaacucccgcuuuccaauaaaucuggaaagacuuuucacgggucccucaagugcgaacgugguucagccucagaaugggagguguacuauugauggcgaguugcugggaaccacacaacuaagcucugugaacaucugcacuuuccggggcgacgucacccauauugguuccacacaccauuggaccaugaaucucgccucaccaaacuggaauaacuacgauccgacggaggaaacucccgcaccucuggggacaccagacuuugugggaaagauccacggcaugcuuacccagacuacacagggcagcgggaguacccgcgcucaccgagccacgguauauguuggaucugcugacuucacccccaaacuggguaaggugcaguuugagacagaaacugaucaugacuuggccaucagacaaaauaccaaguucacaccugucggcgugauucaggaguccgauaaccacagggacgaaccacagcaauggcggcuccccaauuacagcggggcaaacacuuuuaauguccaucuggccccggcuguggcgccuaacuucccaggagagcaguuacuguuuuuccguucgaccauacccggcuguggugggcacccuaauaugaaccucgauugccuucugccccaggaguggguucagcacuuuuaccaagaagcagccccagcucagucugacguggccuugcuacgcuucguaaacccugauacauccagaguccuguuugaguguaaacuccauaagucaggcuaugugaccguugcacacacuggacagcaugaccuggugauucccccaaauggcuacuucagguuugauaguugggucaaccaguucuauacgcuugccccgauggggaauggaacaggucggaaacgauga

SEQ ID NO: 21607 - RNA, 1614 nt, Artificial Sequence
  derived and/or modified sequence opt3 from VP1__Norovirus_and/or_Norovirus-like__KX514240
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaugacguguucacugucagcugcagaguucugaccaggcccaguccggauuuugacuucauuuuucucgugccucccacaguagaaucccggucuaaaccauucagcgugccugucuuaaccguggaggaaaugacuaacucccgcuuucccgccacacuggauaaacuuuucaccggaccaucaaguacguucguugugcagccccagaaugguagauguaugaucgacggcgucuugcuggggacuacccaacuaagcccugugaacauaugcacauuuaggggagauguaacucauccacgggacucuccgauuuacaccaugaaucucgcaucccccaacuggaauaacuaugacccuacagaggagaucccagcuccccugggcaccccugauuucguugguaagauucacgggaugcuuacgcagacuacacagggaucaggcagcacccgcgcccaucgagcuacuguguacgucggcagugccgaauuuacaccaaagcuggggaaggugcaguuccaaaccgagacggaagacgauuuggucaucagacagaauaccaaauuuacacccgugggaguuauccaggagucugaccaccacagggaugaaccgcaacagugggugcucccuuccuacagcggucgggacacuccaaacguacaucuggcacccgccgucgcuccuaccuuccccggcgagcaguuacuguuuuuccguucgacaauuccaggguguggaggccacccuaauaugaaccucgauugccuucugccccaggagugggugcaacauuuuuaucaggaagcggcaccagcccagucugacguugcuuugcuacgcuucgugaauccggauacuuccagaguccuguuugaguguaagcuccacaaaucagguuacgugaccguagcccacacagggcagcaugaccuggugauaccucccaacggcuauuucagguuugauaguuggguuaaucaauucuacacccuugcaccaaugggaaacggcacugggcggaagcgauga

SEQ ID NO: 21608 - RNA, 1614 nt, Artificial Sequence
  derived and/or modified sequence opt3 from VP1__Norovirus_and/or_Norovirus-like__AF414417
augaagauggccagcaacgacgcuaaucccuccgauggcucugcagccaaccuggugccugaggucaauaacgaaguuauggcgcucgagccagugguagacgcugccaucgcagccccgguggcugggcagcaaaaugucauugaucccuggauaagaaacaauuucgugcaggcaccuggaggugaauuuaccguuucaccaaggaacgcccccggcgagauccuuuggagugcuccucuggggccagaccccaauccuuacuugagccacuuaucccggauguauaacggauacgccggcgguuucgaagugcaggucauucuggcggggaaugcauuuacagccggaaaagugaucuucgcugccguaccaccgaacuuucccacugagggccuaucuccuucgcagguuacgauguucccacauauuaucguggauguccgccaacucgagcccaugcugauaccucuuccagacgugcgaaauaacuuuuaucacuacaaucaggcaaacgauucaacccugaaguugaucgcuacacucuauacuccccugcgugccaacaaugcgggcgacgauguguucaccgucagcugcagaguucugacaaggccgaguccugacuuugauuucauuuuucucgugcccccaaccguagaaucccggacuaaaccuuucacagugcccgucuuaaccguggaggaaaugucuaacagccgcuuuccaaucccccuggagaaacuuuacacggggccuuccucagccuucguugugcagccacagaauggaagauguacuaccgacggugucuugcugggcacaacucaacuaagugcagugaacauuugcaauuucaggggagauguagcucauaucgccgggagccacgacuauaccaugaaccucgcuucucagaauugguccaacuacgacccgacagaggaaauacccgccccucugggcaccccagauuuuguugguaagauucaggggcuucugacgcagacuacacgggcagacggauugacccgcgcccauaaggcuacugugucaacaggcagcguccacuucacccccaagcucggcagugugcaauuuacgaccgauacaaauaacgacuuccaggcggggcagaauacuaaauuuaccccugucggagugauccaagauggugaccaccaucagaacgagccacagcaguggcuguuacccaauuacucuggccgaacagggcacaacguucaucuggcaccggccguggcuccuacuuucccaggagaacaacuccuguuuuucagauccaccaugcccggcuguagcgguuauccuaauaugaaccuugauugcuugcuaccccaggaguggguacugcacuuuuaccaggaagccgcaccagcccagucggacgucgcucuccugagguucgugaacccugauacagggcggguucuuuuugaguguaagcugcacaaaucuggcuauauuaccguggcccauacuggacccuacgacuugguccucccaccgaauggcuauuuccguuuugauuccugggugaaccaauucuacacgcuggcaccuauggggaauggaacaggucgcagaagguga

SEQ ID NO: 21609 - RNA, 1614 nt, Artificial Sequence
  derived and/or modified sequence opt3 from VP1__Norovirus_and/or_Norovirus-like__KX514303
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaacguuuccgaccgagggccucucucccucgcagguaacaauguucccucauaucauaguugacgugcgccaacuggagccaguccuuaucccccugccugaugugcgaaauaacuuuuaucacuacaaucagucaaacgacagcacuauuaaguugaucgcaaugcucuauaccccacugcgugcuaauaaccccggggaugacguguucacagucaguugcagaguucugaccaggccguccccugauuuugacuucauuuuucucgugcccccaacuguagaaucucggacaaaaccuuucagcgugcccaucuuaaccgucggagagaugacgaacucccgcuuuccagugaaucuggaaagacuuuucacuggucccucaagugccaacguugugcagccucagaaugggagguguaccauagauggcgaguugcugggaacaacucaacuaagcucugucaacauuugcaccuuccggggcgacgugacacagaucgguuccacccgccauuggacgaugaaucucgcgucaccaaacuggaauaacuacgauccgacugaggaaacacccgccccucuggggaccccagacuuuguaggaaagauucacggcaugcuuacucagacaacccagggcagcgggaguacgcgagcacauagagcuaccguuuaugugggaucugccgaguucacacccaaacuggguaaggucagguuugaaacugacaccgaggaugacuuggugauccggcaaaauacaaaguucacuccugucggcgugauccaguccagcgaucaccaccgugacgaaccacagcaauggcgccuccccaacuacucgggggcuaauaccuuuaacguucaucuggccccggcaguggccccuaauuucccaggagagcaguuacuguuuuucagaucuacacuccccggcuguggugggcacccuaacauggaucuugacugccuguugccccaggaguggguacagcauuuuuaccaagaagcugcgccagcacaguccgaugucgcccuacugagguucgugaauccugacaccucacggguucucuuugaguguaaacugcacaagaguggcuaugugacugucgcucacacgggacaguacgaucuugugcugcccagcaacggcuauuuccgauuugacuccuggguaaaccaguucuacacauuggccccaauggggaauggaaccggucgcagaagguga

SEQ ID NO: 21610 - RNA, 1614 nt, Artificial Sequence
  derived and/or modified sequence opt3 from VP1__Norovirus_and/or_Norovirus-like__KX514273
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaacguuuccgaccgagggccucucucccucgcagguaacaauguucccucauaucauaguugacgugcgccaacuggagccaguccuuaucccccugccugaugugcgaaauaacuuuuaucacuacaaucagucaaacgacagcacuauuaaguugaucgcaaugcucuauaccccacugcgugcuaauaacgccggggaugacguguucacagucaguugcagaguucugaccaggcccuccccggauuuugacuucauuuuucucgugccucccacuguagaaucucggagcaaaccauucuccgugccugucuuaacaguggaggaaaugaccaacucacgcuuucccgcgacgcuggauaaacuuuucacuggaccaaguagcaccuucguugugcagccccagaaugguagauguaugaucgacggcgucuugcuggggacaacucaacuaucuccugugaacauaugcaccuuuaggggagauguaacacauccacgggacuccccgauuuacaccaugaaucucgccucacccaacuggaauaacuaugacccuacggaggagaucccagcaccccugggcacuccugauuucacagguaagauucaggggaugcuuacccagacuacaaagggagaaggcagcacccgcggccaccgagcuacgguuuacguggggagugccgaguuuaccccaaagcugggaaaagucagauucgaaacagacacugaggaugacuuggugaucaggcagaauaccaaguuuacacccgucggugugauccaaucuuccgaucaucaccgggacgaaccgcagcaguggcgucucccuaacuacagcggcgcuaauacuuucaacguucaccuggccccagcaguggcccccaauuuuccuggggagcaauuacuguucuuucgcucgacccuccccggauguggcggucauccaaacauggaucuugacugccuguugccucaggaguggguacagcacuucuaucaggaagcugcgcccgcacaaucugaugucgcccuacugagauuugugaauccagacacauccaggguucucuucgaguguaaacugcauaagucaggguacgugaccgucgcucacacuggccaguaugaucuugugcugccgaguaacggauacuuucgguucgacagcuggguaaaucaguucuauacguuggccccuaugggcaacgggacaggacgacgcagauga

SEQ ID NO: 21611 - RNA, 1614 nt, Artificial Sequence
  derived and/or modified sequence opt3 from VP1__Norovirus_and/or_Norovirus-like__KX514323
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaugacguguucacugucagcugcagaguucugaccaggcccaguccggauuuugacuucauuuuucucgugccucccacaguagaaucccggucuaaaccauucagcgugccugucuuaaccguggaggaaaugacuaacucccgcuuucccgccacacuggauaaacuuuucaccggaccaucaaguacguucguugugcagccccagaaugguagauguaugaucgacggcgucuugcuggggacuacccaacuaagcccugugaacauaugcacauuuaggggagauguaacucauccaggcaauucuaagauuuacaccaugaaccucgcauccccgaauuggaacaauuaugaccccacagaggagaucccugcuccacuggguacccccgacuucguugggaagauucacggaaugcuuacgcagacuacacaggaaaacggcucaacccgggcccaucgcgcuacuguguacgucggcggggccaauuuuacaccuaagcugggaaaagugcaguucgagaccgauacgggugacgauuuggcaauccgacaaaacaccaaguuuacaccagucggcgugauccagagcagugaccaccacagagaugaaccccagcaauggaggcucccgaauuacucuggggccaacacuuucaauguucaucuggcuccugcgguggcaccaaacuuucccggagagcaguuacuguucuuucgguccaccauuccuggcuguggugggcaccccaacaugaaucucgacugccuucugccacaggaauggguacagcauuucuaucaagaggccgcuccugcccagagcgaugucgcauugcuacguuuugugaaccccgacacaucgcgcguucuguucgaguguaaacuccacaagucuggcuacgugacugucgcccacaccggacagcaugaucuggugauaccaccgaauggcuauuuuagauucgacuccuggguaaaccaguucuacacacuugcuccuauggggaauggaaccgguaggaaacgguga

SEQ ID NO: 21612 - RNA, 1614 nt, Artificial Sequence
  derived and/or modified sequence opt3 from VP1__Norovirus_and/or_Norovirus-like__KX514364
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaacguuuccgaccgagggccucucucccucgcagguaacaauguucccucauaucauaguugacgugcgccaacuggagccaguccuuaucccccugccugaugugcgaaauaacuuuuaucacuacaaucagucaaacgacagcacuauuaaguugaucgcaaugcucuauaccccacugcgugcuaauaaccccggggaugacguguucacagucaguugcagaguucugaccaggccguccccugauuuugacuucauuuuucucgugcccccaacuguagaaucucggacaaaaccuuucagcgugcccaucuuaaccgucggagagaugacgaacucccgcuuuccaauaaaucuggaaagacuuuucacuggucccucaagugccaacgugguucagccucagaaugggagguguaccauugauggcgaguugcugggaacaacucaacuaagcucugugaacaucugcaccuuccggggcgacgucacacagauugguuccaccaagcauuggacgaugaaucucgcgucaccaaacuggaauaacuacgauccgacugaggaaacacccgccccucuggggaccccagacuuugugggaaaaauccacggcaugcuuacucagacaacccaggagaauggcagcacgcgcgcacaucgagcuaccguauauguugggggagccaacuucacacccaagcuggguaaggugcaauuugaaacugacaccggcgaugacuuggcuaucagacagaauacaaaauucacuccugucggggugauucagaguucugaucaccacagggacgagccacaacaguggcggcuccccaacuacuccggagccaauaccuuuaacguccaucuggcaccggccguggcuccuaauuucccaggcgaacaguuacuguuuuuccguagcacacuccccgguugugggggccacccuaacauggaucuugacugccuguugccccaggaguggguucaacauuuuuaccaggaggcggcaccagcccagucggauguggcuccucuacgcuucguaaaccccgacaccucuagaguccuguuugaauguaagcuccacaaauccggauaugugacuguugcccacacgggccaguacgaucuggugcuuccaucaaauggguauuucagguuugacaguugggucaaccaauucuacacacuggcaccgaugggaaaugguaccggccggcgacgcuga

SEQ ID NO: 21613 - RNA, 1614 nt, Artificial Sequence
  derived and/or modified sequence opt3 from VP1__Norovirus_and/or_Norovirus-like__KX514338
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaugacguguucacugucagcugcagaguucugaccaggcccaguccggauuuugacuucauuuuucucgugccucccacaguagaaucccggucuaaaccauucagcgugccugucuuaaccguggaggaaaugacuaacucccgcuuucccgccacacuggauaaacuuuucaccggaccaucaaguaauuucguugugcagccccagaacgguagauguaugaucgacggcgucuugcuggggacgacucaacuaagcccugugaauauaugcaccuuuaggggagauguaacacagauuggcucuacuaagcauuggaccaugaaccucgcauccccaaauuggaacaauuacgacccgacagaggagacccccgcuccucuggguacgccagacuucguugggaagauccacggaaugcuuacucagacaacccaggaaaacggcucaacucgggcccaucgcgcuacaguguaugucggcggggccaauuuuacccccaagcugggaaaagugcaauucgagacggauaccgucgacgauuuggaaauucgacagaacacaaaguuuacuccuguggguguuauccagagcagugaccaccacagagaugagccacaacaguggaggcuccccaauuacucuggcgcaaacaccuucaaugugcaucuggccccggcuguagcgccuaacuuuccaggggaacaguuacuguucuuucgguccacacuccccggauguggcggucacccuaacauggaccuugauugccuguugccccaggaguggguccaacauuucuaccaggaggcagccccagcucagagcgacguggcccuacugcguuuuguuaauccugauacuucgcgcguccucuucgaauguaaacugcacaagucuggguaugugaccguggcacacacaggccaguacgaccuuguacugcccuccaacggauauuuuagauucgauucaugggugaaucaauucuacaccuuggccccaaugggcaacgggacuggaaggcggcgauga

SEQ ID NO: 21614 - RNA, 1614 nt, Artificial Sequence
  derived and/or modified sequence opt3 from VP1__Norovirus_and/or_Norovirus-like__KX514316
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaacguuuccgaccgagggccucucucccucgcagguaacaauguucccucauaucauaguugacgugcgccaacuggagccaguccuuaucccccugccugaugugcgaaauaacuuuuaucacuacaaucagucaaacgacagcacuauuaaguugaucgcaaugcucuauaccccacugcgugcuaauaaccccggggaugacguguucacagucaguugcagaguucugaccaggccguccccugauuuugacuucauuuuucucgugcccccaacuguagaaucucggagcaaaccuuucuccgugcccgucuuaacaguggaggaaaugaccaacucacgcuuuccagccacgcuggauaaacuuuucacuggacccaguagcaccuucguugugcagccucagaaugguagauguaugaucgacggcgucuugcuggggacaacucaacuaucuccagugaacauaugcaccuuuaggggagauguaacacauccgcgggacuccaagauuuacaccaugaaucucgcgucacccaacuggaauaacuaugacccuacggaggagaucccagcaccccugggcacuccugauuucguugguaagauucaggggaugcuuacacagaccacuaagggagaaggcagcacacgcggccaccgagccaccguguacgucgggagugcuaauuacgccccaaaacugggaagagugcaguuugagacggacaccacagaugacuuggaugcucaucaaaacacuaaguucacccccgucggugugauccagucuuccgaccaccacagggaugaaccgcagcaauggcggcucccuaauuauagcggcgccaacacauuuaauguucaucuggcaccagccguggcucccaacuucccuggggagcaguuacuguuuuuccguucgacucuccccggauguggcggucacccaaauauggaccuugauugccuguugccucaggaauggguacagcauuuuuaccaagaggcggcacccgcccagucugacgucgcucuacugcgcuucgugaacccagauaccuccagaguucucuuugaguguaaacugcacaagucaggguaugugacagucgcccacaccggccaguacgaccuugugcugccgaguaauggauauuucagguuugacagcuggguaaaccaguucuacacuuuggcaccuaugggcaacgggacgggacggaaacgauga

SEQ ID NO: 21615 - RNA, 1614 nt, Artificial Sequence
  derived and/or modified sequence opt3 from VP1__Norovirus_and/or_Norovirus-like__KX514356
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaacuuuuccgacggagggccucucucccucgcagguaaccauguucccucauaucauaguugacgugcgccaacuggagccaguccuuaucccccugccugaugugcgaaauaacugcuaucacuacaaucagucaaacgacagcacaauuaaguugaucgcuaugcucuauacuccacugcgugccaauaaccccggggaugacguguuuaccgucaguuguagaguucugacaaggccguccccugauuucgacuuuauuuuccucgugcccccaaccguagaaucucggacuaaaccuuuuagcgugcccaucuuaacagucggagagaugaccaacucccgcuucccaauaaaucuggaaagacuuuuuacgggucccucaagugcgaacgugguucagccucagaaugggaggugcacuauugauggcgaguugcugggaaccacacaacuaagcucugugaacaucuguacuuuccggggcgacgucacccauauugguuccacacaccauuggaucaugaaucucgccucaccaaacuggaauaacuacgauccgaccgaggaaacgcccgcaccucuggggacuccagacuucgugggaaagauccacggcaugcuuacacagaccacucagggcagcgggaguacacgcgcucaccgagccaccguauauguuggaucugcugacuuuacgcccaaacuggguaaggugcaguucgagaccgaaacagaucaugacuuggccauuagacaaaauacuaaguuuaccccugucggcgugauacaggaguccgaucaccauagggacgaaccacagcaauggcggcuccccaacuacagcggggcaaauacauucaacguccaccuggccccggcuguggcgccuacuuuuccaggagagcaguuacuguucuuucguucgaccauccccggcugcggugggcacccuaauaugaaccucgauugucuucugccccaggaguggguucagcauuucuaccaagaagcagccccagcucagucugacguggccuugcuacgcuuuguaaauccugauacauccagaguccuguucgagugcaaacuccacaagucaggcuaugugaccguugcacauacuggacagcacgaccuggugauucccccaaacggcuacuuuagguucgauaguugggucaaccaguuuuauacgcuugccccgauggggaauggaacaggucggaaacgauga

SEQ ID NO: 21616 - RNA, 1614 nt, Artificial Sequence
  derived and/or modified sequence opt3 from VP1__Norovirus_and/or_Norovirus-like__KX514349
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaucccggggaugacguguucacugucagcugcagaguucugaccaggccgaguccugauuuugacuucauuuuucucgugcccccaacaguagaaucccggucuaaaccuuucagcgugcccgucuuaaccguggaggaaaugacuaacucccgcuuuccagcgacacuggauaaacuuuucaccggacccucaaguacguucguugugcagccucagaaugguagauguaugaucgacggcgucuugcuggggacuacccaacuaagcccagugaacauaugcacauuuaggggagauguaacucagucuggcaauaccaagauuuacacaaugaaccucgccuccccgaauuggaacaauuaugaccccaccgaggagaucccugcaccacuggguacgcccgacuucguugggaagauucagggaaugcuuacucagacaaccaagggcgaaggcucaacucgggggcaucgcgcuacaguguacgucggaggugccgaguuuaccccuaaacugggcaaggugcgauucgaaacggauaccgaggacgauuuggucaucagacaaaacacaaaauuuacuccaguggggguuauccagaccagcgaaaaucacagggacgagccccagcaauggcggcucccgaacuacaguggacgugauacaccuaaugugcaucuggcuccagccguagcacccacuuucccuggcgagcaguuacuguuuuuccgcucuaccauucccgguugugggggccacccaaacaugaaucucgacugccuucugccucaggaauggguccagcacuuuuaucaagaggccgcucccgcgcaguccgauguggcauugcuaagauucguuaacccagacacaagcagggugcuguuugaauguaagcuccauaaaucgggauacgucaccguggcccacacuggccagcaugaucugguaauaccgccuaacggguauuuccgguuugacucuugggugaaucaguucuacacgcuugcucccaugggaaacgguacaggccgaaagcgcuga

SEQ ID NO: 21617 - RNA, 1614 nt, Artificial Sequence
  derived and/or modified sequence opt3 from VP1__Norovirus_and/or_Norovirus-like__KX514217
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaacuuuuccgacggagggccucucccccucucagguaaccauguucccucauaucauaguugacgugcgccaacuggagccaguccuuaucccccugccugaugugcgaaacaauuuuuaucacuacaaccagucgaaugacucaacaauuaaguugaucgcuaugcucuauacuccacugcgugccaacaacgcgggggaugacguguucaccgucagcugcagaguucugacaaggcccaguccggauuuugacuucauuuuucucgugccucccaccguagaaucccggucuaaaccauucagcgugccugucuuaacuguggaggaaaugacaaauucccgcuuucccgccacccuggauaaacuuuucacgggaccaucaaguacuuucguugugcagccccagaacgguagauguaugaucgacggcgucuugcuggggaccacacaacuaagcccugugaauauaugcacuuuuaggggagauguaacccauccacgggacucuccgauuuacacaaugaaccucgcaucccccaauuggaacaauuaugacccuaccgaggagaucccagcuccccugggcacgccugauuucguugguaagauucaggggaugcuuacucagacaacccagggaucaggcagcacucgcgcccaccgagcuacaguguacgucggcagugccgaauuuaccccaaagcuggggaaggugcaauuccagacggagaccgaccaugauuuggucaucagacagaacacaaaauuuacucccgugggaguuauccaagaaucugaccaccacagggaugagccgcagcaguggcggcucccuaauuacuccggugcaaacaccuucaaugugcaucuggccccagcuguagcgcccaacuuuccuggcgaacaguuacuguucuuucguagcacacuccccggguguggaggccacccaaauauggaccuugauugccuguugccucaagaguggguccagcauuucuaucaggaggcagcccccgcucagucggacguggcccuacugcgcuuuguuaacccagauacuucuagaguccucuucgaauguaagcugcacaaauccgguuacgugaccguggcacacacagggcaauaugaccuuguacugccgucaaauggcuacuuuagguucgauaguugggugaaccaguucuauaccuuggccccuaugggaaacggcacugggcggcgacgcuga

SEQ ID NO: 21618 - RNA, 1614 nt, Artificial Sequence
  derived and/or modified sequence opt3 from VP1__Norovirus_and/or_Norovirus-like__KX514324
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaacguuuccgaccgagggccucucucccucgcagguaacaauguucccucauaucauaguugacgugcgccaacuggagccaguccuuaucccccugccugaugugcgaaauaacuuuuaucacuacaaucagucaaacgacagcacuauuaaguugaucgcaaugcucuauaccccacugcgugcuaauaaccccggggaugacguguucacagucaguugcagaguucugaccaggccguccccugauuuugacuucauuuuucucgugcccccaacuguagaaucucggagcaaaccuuucuccgugcccgucuuaacaguggaggaaaugaccaacucacgcuuuccagccacgcuggauaaacuuuucacuggacccaguagcaccuucguugugcagccucagaaugguagauguaugaucgacggcgucuugcuggggacaacucaacuaucuccagugaacauaugcaccuuuaggggagauguaacacauuccggcaauucaaagauuuacaccaugaaccucgcgagcccgaauuggaacaauuaugaccccacggaggagaucccugccccacuggguacucccgacuucguugggaagauucagggaaugcuuacacagaccacuaagggcgaaggcaguacacgggggcaccgcgcaaccguguacgucggaggugcuaacuuuacgccuaaacugggcaaggugcaguucgagaccgauacagucgacgauuuggaaauccgacaaaauacuaaauuuaccccaguggggguuauccagucuuccgaccaucacagagaugagccccagcaauggaggcucccgaacuacagcggagccaauacauucaacgugcaccuggcuccugccguagcaccaaauuuucccggcgaacaguuacuguucuuucggucgacucucccugguugugggggccaucccaacauggaccuugauugccuguugccacaggaguggguccagcacuucuaucaagaggccgcuccugcgcagucugacguggcacuacugcguuuuguuaaucccgauaccucccgcguccucuucgaauguaagcugcauaaaucaggauacgugacaguggcccacaccggccagcacgaccuuguaauuccaccgaacggguauuuuagauucgauaguugggugaaccaguucuacacucuggcuccuaugggaaaugguacgggcaggaagcgguga

SEQ ID NO: 21619 - RNA, 1614 nt, Artificial Sequence
  derived and/or modified sequence opt3 from VP1__Norovirus_and/or_Norovirus-like__KX514306
augaagauggccagcuccgacgcuaaccccucugauggcucaaccgcaaaucuggugccugaggucaacaaugaaguuauggcccucgagccagugguagggguggcgaucgcugccccggucgcaggacagcaaaacgugauugaccccuggauaagaaauaacuucguucaggccccugguggcgaauuuacagugaguccaaggaaugcucccggggagauccuuuggagcgcaccucugggaccagauuugaaccccuacuuaucccaccuggcccggauguauaauggcuacgcugguggguucgaaguccaggugauucuagccggaaacgcguuuacugcaggcaaaaucauuuucgccgcuguaccuccaacguuuccgaccgagggccucucucccucgcagguuacaauguucccucauaucauaguggacguccgccaacuggagccagugcuuaucccccugccugaugugcgaaauaacuuuuaucacuacaaucagucaaacgacagcacuauuaaguugaucgccaugcucuauaccccacugcgugcaaauaaccccggggaugacgucuucauuguuaguugcagagugcugacaaggccguccccugauuuugacuucaucuuucucguacccccaaccguggaaucucggacuaaaccuuucagcguccccauauuaacagugggagagaugaccaacucccgcuuuccaauuaaucuggaaagacuuuucacgggucccucaagugcuaacguugugcagccucagaaugggagguguacuaucgauggggaguugcugggaaccacacaacuaagcucugucaacauuugcacuuuccggggcgacgugacccagaucgguuccacacagcauuggaccaugaaucucgccucaccaaacuggaauaacuacgauccgacggaggaaacucccgcgccucuggggacaccagacuuuguaggaaagauccagggcaugcuuacccaaacuacacaggagaauggcagcacccgcgcccaccgagcaacgguuuaugugggcggagcuaacuacgcccccaaacuggguaagguccaguucgaaaccgacacaggcgaugacuuggcuauuagacaaaauacuaaguuuaccccugugggggucauacagaguucugaucaucacagggacgagccacagcaguggcggcuccccaacuacuccggagccaauacauucaacgugcaccuggcaccggccguugcuccuaauuuuccaggcgaacaauuacuguucuuucguagcacucuccccgguugugggggccauccuaacauggaucuugacugccuguugccccaggagugggugcagcacuucuaucaggaggcggcaccagcccaaucggauguaacccuacugcgcuuugucaacccugacacaucuagaguucucuucgaauguaaacugcauaaguccggauacgugaccguggcucacacuggccaguaugaucuuguccugcccucaaauggguacuuuagguucgacaguugggugaaccaguuuuauacguuggccccaaugggaaaugguacaggccggcgacgcuga

SEQ ID NO: 21620 - RNA, 1614 nt, Artificial Sequence
  derived and/or modified sequence opt3 from VP1__Norovirus_and/or_Norovirus-like__AB186063
augaagauggccagcaacgacgugaaucccuccgauggcucugcugcaaaccuggucccugagguuaauaacgaagugauggcccucgagccaguagugggggcggcuaucgccgcaccggucgccggacagcaaaauauuauagaccccuggaucagaaacaauuucgugcaggcuccugguggcgaauuuaccguuucaccaaggaacgcacccggggagauucuuuggagugccccucugggaccagauuugaaucccuacuuaagccaccugucccggauguauaacggcuacgcugguggguucgaagugcaggucauccuagccggaaaugcguuuacagcaggcaaagugauuuucgccgcuguaccuccaaacuuuccgacugagggccucucucccucgcagguuacgauguucccucauaucauaguggacguccgccaacuggagccagugcuuaucccccugccugaugugcgaaauaacuuuuaucacuacaaucaggcccaugacucaaccuugaagcucauugcaaugcuguauacaccacugcgugcuaacaacgccggggaugacgucuucacuguuagcugcagagugcucaccaggcccaguccggauuuugacuucaucuuuuuaguaccucccacaguggaaucccggaccaaaccauucacugucccugugcugacaguugaggaaaugaccaauucucgcuuucccauuccacuugagaaguuguacacgggacccagcuccgcguucgugguccagccucagaacgguagauguacuaccgauggcgugcugcuagggacaacucaacucucagccguaaauaucugcaccuucaggggagacguuacacacauagcaggcagucggaacuauaccaugaaucuggcuagccagaacuggaauaacuacgauccaacggaggaaauuccggcuccccuugguacuccugacuuuguggggaaaauccagggacuguugacacagaccacucgcgccgacggcucuacacgagcccauaaggcaaccgucuccacgggcucagugcacuucaccccaaagcucgggagcguccaauuuaguacagauacugacaaugauuuccagcccggacagaacaccaaauuuacaccuguggguguuauucaagacggcgauagacaccagaaugagccacagcagugggugcugcccgacuacucugggaggacuggacauaacguacacuuagccccggcugucgcgccuaccuucccaggcgaacaacugcucuuuuuccgguccacaaugcccgguuguagcggguauccuaauaugaaccuugauugccuguugccccaggagugggugcuacauuuuuaccaggaaucggcaccagcccagucugacguugcucugcuccguuucgugaauccugauaccaaccgcguccuguuugaguguaaacuucacaaguccggcuauaucacuguggcccacacgggacaacaugaccugaucuugcccccaaacggcuacuucagauuugauucauggguaaaucaguucuauacacucgcaccgauggggaacggagccgguaggcggcgauga

SEQ ID NO: 21621 - RNA, 1614 nt, Artificial Sequence
  derived and/or modified sequence opt3 from VP1__Norovirus_and/or_Norovirus-like__AF406793
augaagauggccagcuccgacgcuaaccccucugauggcucaaccgcaaaucuggugccugaggucaacaaugaaguuauggcccucgagccagugguaggggcggcuaucgccggaccgguggcaggucagcaaaacgucauugaccccuggauaagaaauaacuucgugcaggccccuggcggggaauuuacaguuaguccaacuaaugcucccggagagauccuuuggagcgcaccucugggcccagauuugaaccccuacuuaucccaccuggccaggauguauaaugguuacgcugggggauucgaagugcaggucauucuagccggcaacgcguuuacggcaggcaaaaucauuuucgccgcugugccuccaaauuuuccgaccgaggggcucucucccucgcagguaacaauguucccucauaucauaguugacgugcggcaacuggagccaguccuuaucccccugccugaugcccgcaacaauuuuuaucacuacaaccagucaaaugacagcacuauuaaguugaucgcaaugcucuauaccccacugcgagcuaacaacgccggagaugacguguucacagugaguugccguguccugaccagacccuccccggauuuugacuucauuuuucucguuccucccacuguggaaucuaggacaaaaccauucaccguaccuaucuuaacgguggaggaaaugagcaauucccgguuucccauaccacuggagaaacuuuacacuggucccucaagugucuucgugguucagccucagaacggccgcuguaccacagaugggguguugcugggaacuacccaacuaagcgcggucaauauuugcacauucagaggcgacgugacccauaucgccgguucucacgauuauacgaugaaccucgcaucccagaauuggaacaauuacgacccaacugaggaaauuccggcuccccuggggacaccugacuuuguaggaaagauccagggcaugcuuacccagacuacaagggaggauggcucaacccgggccacgaaggcuaccguuagcacagggagugugcauuucacuccaaagcugggaucuguccaauacaccgccgacacaaacaaugauuuucagacuggucagaacaccaaauucacacccgugggcgucauccaagacggguccaaucaccagaacgaaccucagcaguggguguugaccaauuauagcggacgcacuggccacaacguucaucucgcaccagccguggcucccacguuuccgggugagcaacuguuauucuuucgaucgacaaugccuggguguucuggcuacccaaauaugaaccuggauugccuccuuccccaggaauggguacagcacuucuaucaggaggcggccccugcacaauccgacgucgcucuguugagauuugugaaccccgauaccggaaggguucuauucgaguguaagcugcauaaaucaggcuacgugacugucgcccacaccgggccacacgaccucgugauuccucccaauggauauuuucgguucgauccauggguaaaccaguuuuacacacuggcaccgauggguaauggcgccgggcgucgcagauga

SEQ ID NO: 21622 - RNA, 1614 nt, Artificial Sequence
  derived and/or modified sequence opt3 from VP1__Norovirus_and/or_Norovirus-like__KX514223
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaacguuuccgaccgagggccucucucccucgcagguaacaauguucccucauaucauaguugacgugcgccaacuggagccaguccuuaucccccugccugaugugcgaaauaacuuuuaucacuacaaucagucaaacgacagcacuauuaaguugaucgcaaugcucuauaccccacugcgugcuaauaaccccggggaugacguguucacagucaguugcagaguucugaccaggccguccccugauuuugacuucauuuuucucgugcccccaacuguagaaucucggacaaaaccuuucagcgugcccaucuuaaccgucggagagaugacgaacucccgcuuuccaauaaaucuggaaagacuuuucacuggucccucaagugccaacgugguucagccucagaaugggagguguaccauugauggcgaguugcugggaacaacucaacuaagcucugugaacaucugcaccuuccggggcgacgucacacauauugguuccacccaccauuggacgaugaaucucgcgucaccaaacuggaauaacuacgauccgacugaggaaacacccgccccucuggggaccccagacuuugugggaaagauccacggcaugcuuacucagacaacccagggcagcgggaguacgcgcgcacaccgagcuaccguauauguuggaucugccgacuucacacccaaacuggguaaggugcaguuugagacugaaaccgaucaugacuuggcuaucagacaaaauacaaaguucacuccugucggcgugauucaggaguccgaucaccauagggacgaaccacagcaauggcggcuccccaacuacagcggggccaauaccuuuaacguccaccuggcaccggccguggcuccuaauuucccagaugagcaguuacuguuuuuccguucgacacuccccggauguggcggucacccuaacauggaccuugauugccuguugccccaggaguggguucagcauuuuuaccaagaagcggcaccagcccagucugacguggcucuacugcgcuucguaaauccugauaccuccagaguccucuuugaguguaaacugcacaagucaggguaugugacuguugcccauacgggccagcacgaccuugugauacccccaaacggauacuucagguuugauaguugggucaaccaguucuauacacuggcaccgaugggcaaugggaccggacggaaacgauga

SEQ ID NO: 21623 - RNA, 1614 nt, Artificial Sequence
  derived and/or modified sequence opt3 from VP1__Norovirus_and/or_Norovirus-like__KX514318
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaacuuuuccgacggagggccucucccccucucagguaaccauguucccucauaucauaguugacgugcgccaacuggagccaguccuuaucccccugccugaugugcgaaacaauuuuuaucacuacaaccagucgaaugacucaacaauuaaguugaucgcuaugcucuauacuccacugcgugccaacaaccccggggaugacguguucaccgucagcugcagaguucugacaaggccgaguccugauuuugacuucauuuuucucgugcccccaaccguagaaucccggacuaaaccuuucucugugcccaucuuaacagucggagagaugaccaauagccgcuuuccagugaaccuggaaagacuuuucacgggucccuccucagcgaauguugugcagccucagaacgggagguguaugauagauggcgucuugcugggaacuacccaacuaaguccagugaauauuugcacauuccggggcgacguaacucauccgggugggagcaagaucuacaccaugaaccucgccucucccaauuggaacaauuaugauccuacagaggagauuccagcaccccugggaaccccugacuuuguuggcaaaauccacggcaugcuuacgcagacuacacaggaaaacggguccacccgcgcucaucgagccacuguguacgucggaggugcuaauuucacaccaaagcugggcaaggugcaguuugagaccgacacggaagaugacuuggccaucagacaaaacaccaaauucacacccgucggggugauucagucaagcgaucaccacagggacgagccgcagcaauggcggcucccuaauuacaguggacgugauacuccaaacguucaucuggcacccaccguggccccuaauuuucccggcgaacaguuacuguucuuucgcucuacacucccagguugugggggccacccuaacauggaccuugauugccuguugccccaggaguggguacagcauuucuaucaagaggcugcgccagcacaguccgacgucacucuacugagauuugugaacccggauaccagcaggguucucuucgaauguaagcugcacaaaucgggauacgugacagucgcccacaccggccagcaugaccuugugauaccucccaauggguauuuucgguucgauucuuggguaaaccaguuuuacacucuggcuccaaugggaaaugguacgggccgaaagcgcuga

SEQ ID NO: 21624 - RNA, 1614 nt, Artificial Sequence
  derived and/or modified sequence opt3 from VP1__Norovirus_and/or_Norovirus-like__AB186065
augaagauggccagcaacgacgugaaucccuccgauggcucugcugcaaaccuggucccugagguuaauaacgaagugauggcccucgagccaguagugggggcggcuaucgccgcaccggucgccggacagcaaaauauuauagaccccuggaucagaaacaauuucgugcaggcuccugguggcgaauuuaccguuucaccaaggaacgcacccggggagauucuuuggagugccccucugggaccagauuugaaucccuacuuaagccaccugucccggauguauaacggcuacgcugguggguucgaagugcaggucauccuagccggaaaugcguuuacagcaggcaaagugauuuucgccgcuguaccuccaaacuuuccgacugagggccucucucccucgcagguuacgauguucccucauaucauaguggacguccgccaacuggagccagugcuuaucccccugccugaugugcgaaauaacuuuuaucacuacaaucaggcccaugacucaaccuugaagcucauugcaaugcuguauacaccacugcgugcuaacaacgccggggaugacgucuucacuguuagcugcagagugcucaccaggcccaguccggauuuugacuucaucuuuuuaguaccucccacaguggaaucccggaccaaaucuuucacugucccagugcugacaguugaggaaaugaccaauagccgcuuuccuauuccccuugagaaguuguacacgggaccauccucagcguucgugguccagccccagaacgguagauguacuaccgauggcgugcugcuagggacaacucaacucagugccguaaauaucugcaccuucaggggagacguuacacacauagcaggcagccggaacuauaccaugaaucuggcuucucagaacuggaauaacuacgauccuacggaggaaauuccagccccgcuugguauccccgacuuuguggggaaaauucagggacuguugacucagacaacccgcgcugacggcuccacucgagcccauaaggcaacagucucaaccggcagcgugcacuucacgccuaagcucgggaguguccaauuuucuaccgauacagacaaugauuuccagccaggacagaacacuaaauuuacccccguggguguuauccaagacggcgauagacaccagaaugagccucagcagugggugcugccagacuacuccgggaggacaggacauaacguacacuuagcccccgcugucgcgccgacuuucccuggcgaacaacugcucuuuuuccggagcaccaugccagguuguucgggguaucccaauaugaaccuugauugccuguugccucaggagugggugcuacauuuuuaccaggaaucugcacccgcccaguccgacguugcucugcuccguuucgugaauccagauacaaaccgcguccuguuugaguguaaacuucacaagucaggcuauaucaccguggcccacacuggacaacaugaccugauuuugccucccaacggcuacuucagauuugauaguuggguaaaucaguucuauacgcucgcaccaauggggaacggagccgguaggcggcgauga

SEQ ID NO: 21625 - RNA, 1614 nt, Artificial Sequence
  derived and/or modified sequence opt3 from VP1__Norovirus_and/or_Norovirus-like__KX514307
augaagauggccagcuccgacgcuaaccccucugauggcucaaccgcaaaucuggugccugaggucaacaaugaaguuauggcccucgagccagugguaggggcggcuaucgccgcaccgguggucggacagcaaaacgugauugaccccuggauaagaaauaacuucguucaggccccugguggcgaauuuacagugaguccaaggaaugcucccggggagauccuuuggagcgcaccucugggaccagauuugaaccccuacuuaucccaccuggcccggauguauaauggcuacgcugguggguucgaaguccaggugauucuagccggaaacgcguuuacugcaggcaaaaucauuuucgccgcuguaccuccaacguuuccgaccgagggccucucucccucgcagguuacaauguucccucauaucauaguggacguccgccaacuggagccagugcuuaucccccugccugaugugcgaaauaacuuuuaucacuacaaucagucaaacgacagcacuauuaaguugaucgccaugcucuauaccccacugcgugcaaauaaccccggggaugacgucuucacaguuaguugcagagugcugaccaggccguccccugauuuugacuucauuuuucucguacccccaacuguggaaucucggacaaaaccuuucagcguccccaucuuaaccgugggagagaugacgaacucccgcuuuccaauaaaucuggaaagacuuuucacuggucccucaagugcuaacguugugcagccucagaaugggagguguaugauugauggcgucuugcugggaaccacacaacuaagcccagugaacaucugcacuuuccggggcgacguaacccauccgggugggucuaagauuuacacaaugaaucucgccucccccaacuggaauaacuaugauccuaccgaggagacgccagcgccccugggaacuccugacuuuguuggcaaaauccacggcaugcuuacacagaccacucaggaaaaugggucaacacgcgcccaucgagcaaccguguacgucggaggugcuaacuucacgccaaagcugggcaaggugagauuugagaccgacacaggggaugacuuggccaucaggcagaauacuaaauucacccccgucggagugauucaaagcagugaucaccaccgggacgaaccgcagcaguggcgucucccuaacuacucuggcgcuaauacauuuaacguucaucuggccccagcaguggcccccaauuucccuggugagcaauuacuguuuuuccgcuccacucuccccggguguggcggacacccaaacauggaucuugacugccuguugccucaggaauggguacagcauuuuuaucaggaggcugcgcccgcacaaagcgaugucgcccuacugagauucgugaacccagacaccucgaggguucucuuugaguguaagcugcacaaaucuggcuacgugacagucgcucacaccgggcaguaugaucuugugcugccguccaauggauacuuccgguuugacucauggguaaaccaguucuauacuuuggccccuauggguaauggcacggggcgacgcagauga

SEQ ID NO: 21626 - RNA, 1614 nt, Artificial Sequence
  derived and/or modified sequence opt3 from VP1__Norovirus_and/or_Norovirus-like__LC048948
augaagauggccagcuccgacgcuaaccccucugauggcucagcagccaaucuggugccugaggucaacaaugaaguuauggcgcucgagccagugguaggggcugccaucgcagccccgguggcuggacagcaaaacauuauagaccccuggaucagaaauaacuucguccaggcaccugguggcgaauuuaccgugaguccaaggaaugcccccggggagauucuuuggagcgcuccucugggaccagauuugaaccccuacuuaucccaccugucucggauguauaauggcuacgccgguggguucgaaguucaggugauccuagcgggaaacgcauuuacagccggcaaagucauuuucgcugccgugccuccaaauuuuccgacugagggccucucgcccucacagguaacgauguucccucauaucauaguugacgugcgccaacuggagccaguccuuaucccccugccugaugugcgaaacaauuuuuaucacuacaaccagagccaugacaguaccuugaagcucauugcagugcuguauacaccacugcguacuaauaacgcuggggaugacgucuucaccguuuccugcagagugcucacaaggcccucuccggauuuugacuucaucuuuuuaguaccucccaccguggaaagccggacuaaaccauucacagucccuauucugaccguggaggaaauguccaacucacgcuuucccaucccacuugagaaguuguacacgggacccaguagcgccuucguugugcagccucagaaugguagauguacuaccgauggcguccugcuagggacaacucaacucucugcggugaacauaugcaauuucaggggagacguaacccacauuguuggcucccaugagacaaccaugaaccuggccucacagaauuggagcaacuaugauccaacgcagaaaaucccggcaccccuugguacuccucacuuuguggggaagauucagggacuguugacacaaaccacucgggcucacggcaguacacgcgcccauaaggcuaccgucucuacgggcuccgugcacuucaccccaaaacucgggagcguccaguuuacaacugacaccaauaacgacuuccagacaggacaaaauacuaaguuuacccccguggguguuauccaggauggcgaccaucaccagaacgaaccucagcaaugggugcugccaaauuacucggggcgaacaggacacaacguacauuuagcccccgcagucgccccgaccuucccuggcgagcagcugcucuuuuucagaucuacuaugccagguuguuccggguaccccaauaugaaccuugauugccuguugccucacgaaugggugcuacauuuuuaucaggaggcugcgcccgcacagucagacguugcccugcucagguucgugaauccagauacgggccggguccuguuugaauguaaacuucacaagaguggauacaucacaguggcucauaccggcccuuucgaccuggggauucccccaaacggauauuuucguuucgauagcuggguaaaccaauucuacacuuuggccccgauggguaauggcaccgggcgcagaagguga

SEQ ID NO: 21627 - RNA, 1614 nt, Artificial Sequence
  derived and/or modified sequence opt3 from VP1__Norovirus_and/or_Norovirus-like__LC048908
augaagauggccagcuccgacgcuaaccccucugauggcucagcagccaaucuggugccugaggucaacaaugaaguuauggcgcucgagccagugguaggggcugccaucgcagccccgguggcuggacagcaaaacauuauagaccccuggaucagaaauaacuucguccaggcaccugguggcgaauuuaccgugaguccaaggaaugcccccggggagauucuuuggagcgcuccucugggaccagauuugaaccccuacuuaucccaccugucucggauguauaauggcuacgccgguggguucgaaguucaggugauccuagcgggaaacgcauuuacagccggcaaagucauuuucgcugccgugccuccaaauuuuccgacugagggccucucgcccucacagguaacgauguucccucauaucauaguugacgugcgccaacuggagccaguccuuaucccccugccugaugugcgaaacaauuuuuaucacuacaaccagagccaugacaguaccuugaagcucauugcaaugcuguauacaccacugcgugcuaauaacgccggggaugacguguucacugucuccugcagaguucucaccaggcccucuccggauuuugacuucaucuuuuuagugccucccacaguagaaagccggaccaaaccauucacugugccuauucugacagucgaggaaauguccaacucacgcuuucccaucccacuugagaaguuguacaccggacccaguagcgcguucgugguucagccucagaaugguagauguacgacugauggcgugcugcuagggaccacacaacucucugccgucaacauaugcaauuucaggggagacgugacucacauuguaggcucccaugauuauaccaugaaccuggcaucacagaauuggagcaacuacgacccaacagaggaaaucccggcuccccuugguaccccugacuuuguugggaaaauucagggacuguugacgcagacuacacgggcccacggcaguacccgcgcucacaaggccacugugucuacaggcuccguccauuucaccccaaagcucgggagcgugcaauuuacgaccgauacaaauaacgacuuccagacuggacagaauaccaaauuuacacccgucggugugauccaagauggcgaccaccaucagaacgagccucagcaguggguucugccaaauuacucggggcgaacuggacacaacgugcacuuagcacccgccguagcuccgaccuucccuggcgaacaacugcucuuuuucagaucuacaaugccagguuguuccggguaucccaauaugaaccuugauugccuguugccucaggaguggguccuacauuuuuaccaggaaaccgcgcccgcacagccagacguggcccugcucagguucguuaauccugauacuucacgggugcugugugagugcaaacuucccaagaguggcuauaucacggucgcucacacaggaccauacgaccuggugauuccgccuaacggcuauuuucguuucgauagcuggguaaaccaauuuuacaccuuggcccccauggggaauggaacuggucgcagaagguga

SEQ ID NO: 21628 - RNA, 1614 nt, Artificial Sequence
  derived and/or modified sequence opt3 from VP1__Norovirus_and/or_Norovirus-like__KX514312
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaacuuuuccgacggagggccucucucccucgcagguaaccauguucccucauaucauaguugacgugcgccaacuggagccaguccuuaucccccugccugaugugcgaaauaacuuuuaucacuacaaucagucaaacgacagcacaauuaaguugaucgcuaugcucuauacuccacugcgugccaauaaccccggggaugacguguucaccgucaguugcagaguucugacaaggccguccccugauuuugacuucauuuuucucgugcccccaaccguagaaucucggagcaaaccuuucuccgugcccgucuuaacuguggaggaaaugacaaacucacgcuuuccagcgacccuggauaaacuuuucacgggacccaguagcacuuucguugugcagccucagaaugguagauguaugaucgacggcgucuugcuggggaccacacaacuaucuccagugaacauaugcacuuuuaggggagauguaacccauccgggcgguuccaagauuuacacaaugaaucucgccucacccaacuggaauaacuaugacccuaccgaggagaucccagcaccccuggggacgccugacuucguuggaaagauucacggcaugcuuacucagacaacccaggaaaauggcagcacucgggcucaucgcgccacaguguacgucgggggagcuaacuuuaccccaaagcuggguaaagugcaguucgagacggauaccggcgacgauuuggccauccgacaaaauacaaaguuuacucccgucggggugauccagaguucugaccaccacagagaugaaccgcagcaauggaggcucccuaacuacuccggacgggacaccccaaauguucaucuggcacccgccguggcuccuacauuccccggcgagcaguuacuguuuuuccguagcacuauuccagguugugggggccacccuaacaugaaucucgauugccuucugccccaggaauggguacagcauuuuuaucaagaggcggcaccagcccagucggacgucgcuuugcuacgcuucgugaacccggauaccucuagaguucuguuugaguguaaacuccacaaguccggauacgugacagucgcccacaccggccagcaugaccuggugauaccucccaauggguauuucagguuugauucauggguaaaccaguucuacacucuugcaccaaugggaaacgguacgggccggaaacgauga

SEQ ID NO: 21629 - RNA, 1614 nt, Artificial Sequence
  derived and/or modified sequence opt3 from VP1__Norovirus_and/or_Norovirus-like__KX514237
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagugggaaaugcauuuacagccggcaaaaucauuuucgcugccguaccuccaaacuuuccgacugagggccucucccccucucagguuacgauguucccucauaucauaguggacguccgccaacuggagccagugcuuaucccccugccugaugugcgaaauaacuuuuaucacuacaaucagucgaacgacucaaccauuaaguugaucgcaaugcucuauacaccacugcgugcuaacaaugccggggaugacgucuucacuguuagcugcagagugcugaccaggcccaguccggauuuugacuucauuuuucucguaccucccacaguggaaucccggucuaaaccauucagcgucccuguguuaaccguugaggaaaugacuaacucccgcuuucccgcgacacuggauaaacuuuucaccggaccaucaaguacguucgugguccagccccagaaugguagauguaugaucgacggcguguugcuggggacuacccaacuaagcccuguaaacauaugcacauuuaggggagauguuacucauccacgggacucuccgauuuacaccaugaaucucgccucccccaacuggaauaacuaugacccuacagaggagaucccagcaccccugggcaccccugauuucguggguaagauucaggggaugcuuacgcagacuacacagggaucaggcagcacccgcgcucaccgagccacugucuacgugggcagugcugacuuuacaccaaagcuggggaagguccaauucgaaaccgagacggaucaugacuuggccaucagacagaauaccaaauuuacacccgugggaguuauccaggaaucugaucaccacagggacgagccgcaacaguggcggcucccuaacuacuccggugcaaauacuuucaacgugcaucuggccccagcuguagcgcccaauuuuccuggcgaacaguuacuguucuuucguagcacccuccuuggguguggaggccaccccaacauggaucuggacugcuugcuaccacaggaguggguccaacauuucuaucaggaggcagccccugcucagucggauguggcccugcuccgcuuuguuaaucccgacacaucuagagugcuguucgaauguaaacuucacaaguccgguuacgucacuguggcacacaccgggcaguaugaucugguauugccaucaaacggcuacuuuagguucgacaguugggugaaccaauucuauacacucgccccgaugggaaauggcaccgggcggcgacgcuga

SEQ ID NO: 21630 - RNA, 1614 nt, Artificial Sequence
  derived and/or modified sequence opt3 from VP1__Norovirus_and/or_Norovirus-like__DQ419907
augaagauggccagcaacgacgcuucccccucugauggcucaaccgcaaaucuggugccugaggucaacaaugaaguuauggcccucgagccagugguaggggcggcuaucgccgcaccgguggccggacagcaaaacgucauugaccccuggauaagaaauaguagcgugcaggcuccugguggcgaguucacaguuuccccaagggaugcacccggggaaauccuuuggucugccccucugggaccagacuugaaccccuacuuaucgcaccuggcucggauguauaauggcuacgccgguggguuugaagugcaggucauucuagcgggaaacgcauucacugccggcaaaaucauuuuugcugccgcaccuccaaauuucccgacggagggccucucacccagccaggugaccauguuuccucauaucauaguagggguucgccaacuggagccagugcuuaucccccugccugauguccgaaacaauuucuaucacuacaaccagaguaaugacuccacaauuaaguugaucgcuaugcucuauacuccacugcgugccaacaaugcgggagaugacguguuuaccgugucuugcagaguccugacaaggcccagcccggauuucgacuuuauuuuccucguuccucccaccguggaaucccggacuaaaccauuuacaguaccuaucuuaaccguggaggaaaugacgaacucacgcuuccccauaccacuggagaacuguaguagaguccccgccgugccucuuagcucuaaucauaagaugcagugcacuaccgaugguguuuugcugggcacaacucagcuauccccagugaacauuuguaccuuuaggggagacgucacacacaucccggggacccggacguaccgcaugaaucucgcaucacaaaacuggaauaacuaugaucccacugaggaaauuccugcuccacugggcacacccgacuucguggguaaaauccaggggaugcuuacccagacuacaaagggagacggcagcacccgaggccauaaggccacgguaaguaccgggucuguugauuucacaccuaaacugggauccgugcaguuugcuacugacaccgauaaugacuucgagacaggucaaaacacuagauuuaccccagucggcgugauccaggaugggagcucgacacacaggaaugaaccccagcaaugggucuugccggacuacucuggacggaccgugcacaacguucaucucgccccugcaguggccccaacuuuccccggcgagcagcuguuauuuuuccguuccacgaugccugguugcucaggguaccccaauauggaucuggacugucuccuuccacaggaauggguacagcacuuuuaucaagaggcugcgccuagucagagcgaugucgcacuguugcgcuucgugaaccccgacacaggcagaguucuauuugagugcaagcugcauaaagccggauacgugaccgucgcucacacuggccagcacgaucucgugauuccaccgaauggguauuucagguuugacuccuggguaaaccaguucuacacccuggccccuaugggaaauggugcaggccggcgacgcuga

SEQ ID NO: 21631 - RNA, 1614 nt, Artificial Sequence
  derived and/or modified sequence opt3 from VP1__Norovirus_and/or_Norovirus-like__JN975543
augagaaugagcgacggcgccgcucccaaggcaaacggguccgaggccucuggacaggaucuggugccuaccgcggucgaacaagcuguuccaauccagccgguggccggugcagcccucgcugcacccgccgcuggccagauuaaucagauagacccuuggaucuuccaaaacuuuguacagugcccacuuggggaguucucaauuagucccaggaauacaccuggagaaauccuguuugauuuggccuuaggcccaggucugaaccccuaccuagcgcaccucagcgcaauguauacugggugggugggaaauauggagguccagcuggugcuugccggcaacgcuuucacggccggcaaaguuguggucgcacuggugccuccauacuuuccgaagggguccuugaccacagcucagauuacuuguuucccccauguaaugugcgacguucggacccucgaaccuauccaacugccacugcucgaugugcgccgagucuuauggcacgccacacaggaccaggaggagucuaugcgucugguguguaugcuuuauacccccuugagaacuaauucgccuggagaugaaucauuuguggucagcgguaggcugcuaaguaaaccagcggccgacuucaacuuuguuuaccucacacccccgauagagcggaccaucuaucgcaugguggaucugccuguacuucagcccagacugugcacgcaugcaagguggccagcuccuguguacggcuugcucgucgaccccucccugccaucuaauccccaauggcagaacgggcgggugcacguugauggaacuuuacugggcaccacaccugugagcgguuccugggucucauguuucgccgcugaagccgcauaugaguuucagagugggacuggagagguggccaccuucacacucauugaacaagacggcaccgcuuacguaccaggcgaucgcgcggcaccgcuuggguaccccgacuuuagcggacagcuggagaucgaaguucagacggagacuacaaaggccggugacaaauugaaggugaccacuuucgaaaugauucuaggcccuacaaccaaugucgaucaggcuccauaucaagggcgaguguacgccucuaucacggcaauggccucccuggaccucgucgauggaagagugagggcuguuccccggucaauauauagcuuccaggacgugauuccugaguacaacgauggccugcuuguaccacuggccccuccgaucggucccuuuuugccaggggagguccuccugcguuuccgcaccuauaugagacaguuagacacagcagaugcggcugccgaagcaauugacugcgcccugccccaggaguuuaucaguugguucgcuucuaaugccuuuacugugcaauccgaagcacuacuccugagguaccggaacacccuuacaggccaguugcuguucgaguguaagcucuauagcgaaggauacaucgcucugucguacucuggcuccggggcccuuacuuuuccuaccgauggauucuuugagguugugucaugggucccccgacuguaucaguuggcgaguguggguagccucgccacaggccgcuga

SEQ ID NO: 21632 - RNA, 1614 nt, Artificial Sequence
  derived and/or modified sequence opt3 from VP1__Norovirus_and/or_Norovirus-like__JN975541
augagaaugagcgacggcgccgcucccaaggcaaacggguccgaggccucuggacaggaucuggugccuaccgcggucgaacaagcuguuccaauccagccgguggccggugcagcccucgcugcacccgccgcuggccagauuaaucagauagacccuuggaucuuccaaaacuuuguacagugcccacuuggggaguucucaauuagucccaggaauacaccuggagaaauccuguuugauuuggccuuaggcccaggucugaaccccuaccuagcgcaccucagcgcaauguauacugggugggugggaaauauggagguccagcuggugcuugccggcaacgcuuucacggccggcaaaguuguggucgcacuggugccuccauacuuuccgaagggguccuugaccacagcucagauuacuuguuucccccauguaaugugcgacguucggacccucgaaccuauccaacugccacugcucgaugugcgccgagucuuauggcacgccacacaggaccaggaggagucuaugcgucugguguguaugcuuuauacccccuugagaacuaauucgccuggagaugaaucauuuguggucagcgguaggcugcuaaguaaaccagcggccgacuucaacuuuguuuaccucacacccccgauagagcggaccaucuaucgcaugguggaucugccuguacuucagcccagacugugcacgcaugcaagguggccagcuccuguguacggcuugcucgucgaccccucccugccaucuaauccccaauggcagaacgggcgggugcacguugauggaacuuuacugggcaccacaccugugagcgguuccugggucucauguuucgccgcugaagccgcauaugaguuucagagugggacuggagagguggccaccuucacacucauugaacaagacggcaccgcuuacguaccaggcgaucgcgcggcaccgcuuggguaccccgacuuuagcggacagcuggagaucgaaguucagacggagacuacaaagaccggugacaaauugaaggugacuacauucgaaaugauucuaggcccuaccacgaaugucgaucaggccccauaucaagggcgaguguacgcuucuaucaccgccgcagccucccuggaccucgucgauggaagagugagggcuguuccccggucaauauauagcuuccaggacgccauuccugaguacaacgauggccugcuugugccacuggcacccccgaucgguccauuuuugccuggggagguacuccugcguuuccgcacauauaugagacaguuagacacugcggaugcugccgcagaagccauugacugcgcucugccccaggaguuuaucaguugguucgccucuaaugcauuuaccguccaauccgaagcucuacuccugagguaccggaacacacuuacuggccaguugcuguucgaguguaagcucuauagcgaaggauacaucgcccugucguacucuggcuccggggcgcuuaccuuuccuacagauggauucuuugaggugguuucaugggugccccgacuguaucaguuggccagugucgguagccucgcuaccggccgcuga

SEQ ID NO: 21633 - RNA, 1614 nt, Artificial Sequence
  derived and/or modified sequence opt3 from VP1__Norovirus_and/or_Norovirus-like__KF113526
augagaaugagcgacggcgccgcucccaaggcaaacggguccgaggccucuggacaggaucuggugccuaccgcggucgaacaagcuguuccaauccagccgguggccggugcaucacucgccgcucccgcagccggccagauuaaucagauagacccuuggaucuuccaaaacuuuguacagugcccacuuggggaguucaguauuagccccaggaauacaccuggagaaauccuguuugauuuggcuuuaggcccaggucugaaccccuaccuagcccaccucuccgcgauguauacugggugggugggaaauauggagguccagcuggugcuugcaggcaacgccuucacggcuggcaaaguuguggucgcccuggugccuccauacuuuccgaaggggucuuugaccgcagcucagauuacauguuucccccauguaaugugcgacguucggacucucgaaccuauccaacugccacugcucgaugugcgccgagucuuauggcacgccacccaggaccaggaggagucgaugcgucugguguguaugcuuuauacacccuugagaaccaauucaccuggagaugagagcuuuguggucagugguaggcugcuauccaaaccagcggccgacuucaacuuuguuuaccucacucccccgauagaacggacaaucuaucgcaugguggaucugccuguacuucagcccagacugugcacccaugcaagguggccagcuccuguguacggcuugcucgucgaccccucucugccaagcaauccccaauggcagaacgggcgggugcacguugauggaacguuacugggcacuaccccuguguccgguucaugggucaguuguuucgccgcugaagccgcauaugaguuucagagcgggacaggagagguggccacuuucacccucauugaacaagacggcucugcuuacguaccaggcgaucgcgcggcaccgcuuggguaccccgacuuuuccggacagcuggagaucgaaguucagacagagaccacgaaggccggugacaaauugaaggugacuacauucgaaaugauucuaggcccuaccacuaaugucgaucaggcuccauaucaagggcgaguguacgccucacugacagcagccgcuagccucgaccuggucgauggaagagugagggccguuccccggaguaucuauggcuuccaggaccagauaccugaguacaacgauggucuucuggugccauuggcacccccgguagggccuuuucucccaggcgagcuguuacugcguuuccgcaccuauaugagacagauugacucugcggaugcugccgcagaagccaucgacugcgcucuaccccaagaguuuauuuccugguucgccagcaaugcauuuacgguccagucggaagcucuccugcuuagguaccggaacaccuugacaggacagcuccuguucgaguguaagcuguauucugaaggcuacaucgcccuuuccuacucagggaguggaccucugacuuuucccaccgaugguuucuuugaggugguuagcugggugccacgauuguaucagcucgcguccgucggcucucuggccacagggcgcuga

SEQ ID NO: 21634 - RNA, 1614 nt, Artificial Sequence
  derived and/or modified sequence opt3 from VP1__Norovirus_and/or_Norovirus-like__KF113527
augagaaugagcgacggcgccgcucccaaggcaaacggguccgaggccucuggacaggaucuggugccuaccgcggucgaacaagcuguuccaauccagccgguggccggugcaucacucgccgcucccgcagccggccagauuaaucagauagacccuuggaucuuccaaaacuuuguacagugcccacuuggggaguucaguauuagccccaggaaugcuccuggagaaauccuguuugauuuggccuuaggcccaggucugaaccccuaccuagcgcaccucuccgcaauguauacagggugggugggaaauauggagguccagcuggugcuugccggcaacgcuuucacugccucuaaaguuguggucgcacuggugccuccauacuuuccgaagggcucguugacgaccgcucagauuacauguuucccccauguaaugugcgacguucggacucucgaaccuauccaacugccacugcucgaugugcgccgagucuuauggcacgccacccaggaccaggaggagucaaugcgucugguguguaugcuuuauacacccuugagaaccaauagcccuggggaugaaaguuuuguggucuccggaaggcugcuaucuaaaccagcggccgacuucaacuuuguuuaccucacucccccgauagagcggacaaucuaucgcaugguggaucugccuguacuucagcccagacugugcacccaugcaagguggccagcuccuguguacgguuugcucgucgaccccagccugccauccaauccccaauggcagaacggccgggugcacguugaugggacguuacugggaacuaccccugugucaggcaguugggucagcuguuucgccgcugaagccgcauaugaguuucagucugguacaggggagguggccacuuucacccucauugaacaagacggauccgcuuacguaccaggcgaucgcgcggcaccgcuuggcuaccccgacuuuucagggcagcuggagaucgaaguucagacagagaccacgaaggccggagacaaauugaaggugacuacauucgaaaugauucuagguccuaccacuaaugucgaucaggcuccauaucaaggccgaguguacgccagccugacagcagccgcuagucucgaccuggucgaugggagagugagggccguuccccggucuaucuauggauuccaggaccagauaccugaguacaacgauggccuucuggugccauuggcacccccgguagguccuuuucucccaggggagcuguuacugcguuuccgcaccuauaugagacagauugacuccgcggaugcugccgcagaagccaucgacugcgcucuaccccaagaguuuauuagcugguucgccucgaaugcauuuacgguccagucugaagcucuccugcuuagguaccggaacaccuugacaggccagcuccuguucgaguguaagcuguauuccgaaggauacaucgcccuuucauacaguggcagcgggccucugacuuuucccaccgauggauucuuugaggugguuuccugggugccacgauuguaucagcucgcgucugucgguagccuggccacaggccgcuga

SEQ ID NO: 21635 - RNA, 1614 nt, Artificial Sequence
  derived and/or modified sequence opt3 from VP1__Norovirus_and/or_Norovirus-like__KM458057
augagaaugagcgacggcgccgcucccaaggcagauggguccgaggccucuggacaggaccuggugccuaccgcggucgaacaagcuguuccaauccagccgguggccggugcagcccucgcugcacccgccgcuggccagauuaaccagauagauccuuggaucuuccaaaauuuuguacagugcccacuuggggaguucucaauuagucccaggaacacaccuggagaaauccuguuugacuuggccuuaggcccaggucugaaucccuaccuagcgcaccucagcgcaauguauacugggugggugggaaacauggagguccagcuggugcuugccggcaaugcuuucacggccggcaaaguuguggucgcacuggugccuccauacuuuccgaagggguccuugaccacagcucagauuacuuguuucccccauguaaugugcgauguucggacccucgaaccuauccaacugccacugcucgacgugcgccgagucuuauggcacgccacacaggaucaggaggagucuaugcgucugguguguaugcuuuauacccccuugagaacuaacucgccuggagacgaaucauuuguggucagcgguaggcugcuaaguaaaccagcggccgauuucaauuuuguuuaccucacacccccgauagagcggaccaucuaucgcaugguggaccugccuguaauucagcccagacuuugcacgcaugcaagguggccagcuccuguguacggccuguuggucgaucccucccucccaucuaacccccaauggcagaaugggcgggugcacguugacggaacucuguuaggcaccacaccugugagcgguuccugggucucauguuucgccgcugaagccgcauaugaguuucagagugggacuggacaaguggccaccuucacacugaucgagcaggauggcagcgcuuacguaccaggcgaccgcgcggcaccgcucggguaccccgacuuuucuggacagcuugaaauugagguucagaccgaaacgacuaagacaggugauaaacugaaggugaccacuuucgagaugaucuugggcccuacaaccaacgucgaccaagccccauaucaggggaagguguucgcuuccauaacggccgcagccucacuagaucuggucgacggacgagugagagcuguucccaggagcauuuacggcuuucaggaugugaucccugaauauaaugacggucuccugguaccacuugcacccccgauugggccuuuccugccaggcgaggucuugcuccgguuucguaccuacaugcgccagcuggauacagccgacgcggcugccgaggcaaucgauugcgccuuaccccaagaauuuaucaguugguuugcuucuaacguguucacuguucaguccgaggcccugcuacucagauauaggaauacccugacaggacagcuuuuguuugaauguaaacuguacagcgagggcuauauugcacucucguacucuggguccggaccucugacuuuccccaccgacgguuucuucgaaguggucucaugggugccacggcuuuaccagcuggcuaguguaggcagcuuggccacagggcgauga

SEQ ID NO: 21636 - RNA, 1614 nt, Artificial Sequence
  derived and/or modified sequence opt3 from VP1__Norovirus_and/or_Norovirus-like__AB662855
augaagauggccagcaacgacgcugcacccuccaccgauggcgccgcggggcuggugccugagucuaauaacgaagucauggcucucgagccaguugccggagcagcccuugcugcaccggugacaggucagacuaauaucauugaccccuggauaagagccaacuucguacaagcuccuaauggcgaauuuacggugucaccaaggaacgcccccggggagguccuguugaguuuagaacugggaccugagcuaaauccauaccucgcgcaccuggcacggauguauaacggccaugccggugggauggaggugcagguuaugcuugcuggaaaugccuucaccgcaggcaaacugguguuugcugccgugcccccucacuucccagucgaaaacuugagcccgcagcagaucacaauguuuccccauguaauuaucgauguucgcacucucgagccugugcugcugccacuccccgacguccgaaauaacuucuuucacuacaaucaaaaggaugacccuaaaaugcguauuguggcgauguuauauaccccacugagauccaacggcucuggggaugacguguucacagucucgugcaggguucuuacccggcccucaccggauuuugacuucacuuacuuggugccucccacaguagaaagcaagaccaaaccauuuacgcugccuauccuaacucucggagagcugaguaauucccgcuuccccgugucuauagaucagauguauaccagcccaaacgaggucaucuccgugcagugucagaacgguagaugcacacuugacggcgaacugcaagggacuacccaguugcagguuucaggaauuugugccuuuaagggcgaggugacagcacaucuccacgauaaugaccaccuguacaacgucaccaucacgaauuuaaacgguagucccuucgacccuagcgaagaugugccagcuccgcuggggguacccgacuuccagggaaggguuuuuggcgugauuucucaacgggauaagcagaaugccgcuggccauaacgagccugccaaucgcgggcacgacgcagucgugccaacuuauacagcccaguacacccccaaacucggacaaguccagaucgguacuuggcagacagaugaccuucaggugaaccaaccuguuaaguucaccccagugggccugaaugauacggaacauuuuaaccaguggguagucccccgauacgcuggggcguugaaucuaaacaccaaucuggcaccguccguggccccuguuuucccaggagagagacuccuguuuuucaggucauauauaccccuuaaaggcgguuacgggaacccugcuauugacugccuguugccccaggagugggugcagcacuuuuaucaagaagccgcaccaagcaugagugaggucgcccucgugcgguacaucaauccugauacaggccgugcucuguucgaagccaaguuacaccgcgcaggauuuaugacuguaucuuccaacaccagcgcgcccgugguugucccagcuaacggcuauuucagauuugacucgugggugaaucaguucuacucucuggccccgauggggacaggaaacgguuga

SEQ ID NO: 21637 - RNA, 1614 nt, Artificial Sequence
  derived and/or modified sequence opt3 from VP1__Norovirus_and/or_Norovirus-like__AB809997
augaagauggccagcaacgacgcugcacccuccaaugauggcgccgcgucucuggugccugaggcuaucaacgaaaccaugccacucgagccggucgccggggcaucaauugccgcucccguugcaggacagacaaauauaaucgacccuuggauuagaacuaacuucgugcaagccccaaauggugaauuuacgguaagucccaggaacagcccuggcgagauccuucugaauuuggaauuagggccagaucugaaccccuaccuagcucaccucucccggauguauaauggauacgccggcgguguggagguccaggugcugcuugcggggaacgcauucaccgccggaaaaauucuguuugcugccaucccuccaaauuucccgguugacaugauaucucccgcacagaucacaauguugccucaucucauuguggauguccgcacucuggagccaaucaugauuccccugccugacgugcgaaacguauuuuaucacuucaauaaccagccacaaccccguaugagacucguugcuauguuauacaccccgcugaggucgaauggcucaggcgaugacguguuuacagucagcugccgggugcuuacccgcccuacucccgauuucgaauuuaucuauuuggugccaccuagugucgaguccaagacaaaacccuucacccugccaauacuaacgauuucugaacucacuaacagcagauuucccaucccuauugagcagcuguacaccgccccaaacgagaauaacguugugcagugucagaaugggaggugcacacuugacggagaacugcaagguacuacccaguugcucuccucagcgguauguaguuaucggggccgcacaguggccaacagcggggauaauugggaccagaaccuguuacagcugaccuacccgucuggagcauccuacgaucccacggacgaggucccugcuccacucggcacucaagacuucucagguauccuuuauggggugcugacacaggauaaugaacgagagggaaccggcgaagccaagaacgcuaaaggcguuuacaucagcacuacaagugggaaguuuacccccaagauuggaucuauagguuugcauuccaucacggagaaugugcacccuaaccagcaaagcagauucaccccagucggcguggcccagaaugagaacacacccuuccagcaguggguacuaccgcauuaugcaggggcccuggcucucaauacuaaccuggcgccugcaguugccccaaccuuucccggagaacaacuucuguucuuuaggucgcgggugccuugcguccagggcuugcguggucaggacgcuuucauugauugucuccugccccaggagugggugaaucacuuuuaccaagaagccgcaccaucucaggccgacgucgcuuuaauccgcuaugugaacccugauacagggagaacucuguucgaggccaaacuacacagguccggcuuuauaaccguuucacauacaggagcauacccccucgugguaccaccgaacggccacuuccgguuugacaguugggucaaucaguucuauagccuggcgccuauggggaccggaaacgguuga

SEQ ID NO: 21638 - RNA, 1614 nt, Artificial Sequence
  derived and/or modified sequence opt3 from VP1__Norovirus_and/or_Norovirus-like__AB810001
augaagauggccagcaacgacgcugcacccuccaaugauggcgccgcgucucuggugccugaggcuaucaacgaaaccaugccacucgagccggucgccggggcaucaauugccgcucccguugcaggacagacaaauauaaucgacccuuggauuagaacuaacuucgugcaagccccaaauggugaauuuacgguaagucccaggaacagcccuggcgagauccuucugaauuuggaauuagggccagaucugaaccccuaccuagcucaccucucccggauguauaauggauacgccggcgguguggagguccaggugcugcuugcggggaacgcauucaccgccggaaaaauucuguuugcugccaucccuccaaauuucccgguugacaugauaucucccgcacagaucacaauguugccucaucucauuguggauguccgcacucuggagccaaucaugauuccccugccugacgugcgaaacguauuuuaucacuucaauaaccagccacaaccccguaugagacucguugcuauguuauacaccccgcugaggucgaauggcucaggcgaugacguguuuacagucagcugccgggugcuuacccgcccuacucccgauuucgaauuuaucuauuuggugccaccuagugucgaguccaagacaaaacccuucacccugccaauacuaacgauuucugaacucacuaacagcagauuucccaucccuauugagcagcuguacaccgccccaaacgagaauaacguugugcagugucagaaugggaggugcacacuugacggagaacugcaagguacuacccaguugcucuccucagcgguauguaguuaucggggccgcacaguggccaacagcggggauaauugggaccagaaccuguuacagcugaccuacccgucuggagcauccuacgaucccacggacgaggucccugcuccacucggcacucaagacuucucagguauccuuuauggggugcugacacaggauaauguuagcgaaggaaccggcgaggccaagaacgcuaaaggcguguacaucaguacuacaucugggaaguuuacccccaagauuggauccauagguuugcauagcaucacggaaaauguccacccuaaccagcaaucgcgauucaccccagugggcguagcccagaaugagaacacacccuuccagcaguggguucuaccgcauuaugcaggggcccuggcucucaauacuaaccuggcgccugcaguggccccaaccuuucccggagagcaacuucuguucuuuagaucuagggucccuugcgugcagggcuugcggggucaggacgcuuucauugauugucuccugccccaggaaugggucaaucacuuuuaccaagaggccgcaccaucccaggccgacguggcuuuaauccguuauguuaacccugauacagggcgcacucuguucgaagccaaacuacacagaucaggcuuuauaaccgugagucauacaggagcauacccccucguagucccaccgaacggccacuucagguuugacagcugggugaaucaguucuauucccuggcgccuauggggaccggaaacgguuga

SEQ ID NO: 21639 - RNA, 1614 nt, Artificial Sequence
  derived and/or modified sequence opt3 from VP1__Norovirus_and/or_Norovirus-like__AB809992
augaagauggccagcaacgacgcugcacccuccaaugauggcgccgcgucucuggugccugaggcuaucaacgaaaccaugccacucgagccggucgccggggcaucaauugccgcucccguugcaggacagacaaauauaaucgacccuuggauuagaacuaacuucgugcaagccccaaauggugaauuuacgguaagucccaggaacagcccuggcgagauccuucugaauuuggaauuagggccagaucugaaccccuaccuagcucaccucucccggauguauaauggauacgccggcgguguggagguccaggugcugcuugcggggaacgcauucaccgccggaaaaauucuguuugcugccaucccuccaaauuucccgguugacaugauaucucccgcacagaucacaauguugccucaucucauuguggauguccgcacucuggagccaaucaugauuccccugccugacgugcgaaacguauuuuaucacuucaauaaccagccacaaccccguaugagacucguugcuauguuauacaccccgcugaggucgaauggcucaggcgaugacguguuuacagucagcugccgggugcuuacccgcccuacucccgauuucgaauuuaucuauuuggugccaccuagugucgaguccaagacaaaacccuucacccugccaauacuaacgauuucugaacucacuaacagcagauuucccaucccuauugagcagcuguacaccgccccaaacgagaauaacguugugcagugucagaaugggaggugcacacuugacggagaacugcaagguacuacccaguugcucuccucagcgguauguaguuaucggggccgcacaguggccaacagcggggauaauugggaccagaaccuguuacagcugaccuacccgucuggagcauccuacgaucccacggacgaggucccugcuccacucggcacucaagacuucucagguauccuuuauggggugcugacacaggauaauguuagcgaaggaaccggcgaggccaagaacgcuaaaggcguguacaucaguacuacaucugggaaguuuacccccaagauuggauccauagguuugcauagcaucacggaaaauguccacccuaaccagcaaucgcgauucaccccagugggcguagcccagaaugagaacacacccuuccagcaguggguucuaccgcauuaugcaggggcccuggcucucaauacuaaccuggcgccugcaguggccccaaccuuucccggagagcaacuucuguucuuuagaucuagggucccuugcgugcagggcuugcggggucaggacgcuuucauugauugucuccugccccaggaaugggucgaccacuuuuaccaagaggccgcaccaucccaggccgauguggcuuuaauccguuauguuaauccugacacagggcgcacucuguucgaagccaaacuacacagaucaggcuuuauaaccgugagucauacaggagcauacccccucguagucccaccgaacggccacuucagguuugauagcugggugaaccaguucuauucccuggcgccuauggggaccggaaaugguuga

SEQ ID NO: 21640 - RNA, 1611 nt, Artificial Sequence
  derived and/or modified sequence opt3 from VP1__Norovirus_and/or_Norovirus-like__AY130761
augaagauggccagcaacgacgcuacccccuccgaugacggcgcagccgggcuggugccugagaucaauaacgaagucauggcgcucgagccaguugcuggagccucuauugcagccccggugguaggucagcaaaauauaaucgaucccuggauuagaaacaauuucgugcaggcuccugcaggcgaauuuacagucucaccaaggaacagucccggggagcuucuguuggacuuagaacugggaccugagcuaaauccauaccucgcccaccuggcucggauguauaacggccaugccggugggauggaggugcagaucguucuugcgggaaaugcauucacugccggcaaaauucuguuugcugccauacccccuagcuucccauacgaaaacuuguccccggcacagcucacgaugugcccccacgugaucgucgaugugcgccaacuggagccuguacugcucccaaugcccgacauccgaaauguguuuuaucauuacaaccagaauaacucuccuaaguuacgucugguugcuaugcuuuauaccccauugagagccaauaacucgggcgaugacgucuucacagugucauguagggugcugacucggcccagcccggauuuucaguucaccuuucuagucccucccacaguugaaaguaaaaccaagaacuucacucucccagugcugcgcguauccgagaugacaaauucuagauuuccugugguccuugaccagauguacaccagcaggaacgagaauauuaucgugcaaccccagaacgggcggugcacgacugauggagaacuguuggguaccacaacucuccaguccguuucaauuuguaauuuccgcggcaccaugcaggcgaaacugaacgagcaaccacgauaucaguuacagcugacaaaucucgacgggagucccaucgauccuaccgacgacaugccagccccgcuuggaacgcccgauuuucaagcaaugcuguacggcguggcuagccagagaucuuccagggacaacgccacucgggcucacgaugcccagauagacacagccggugauaccuucgcaccuaagauugggcagguccguuucaagucaagcagugacgauuuugacuugcaugauccaacuaaauucacacccaucggagugaauguagacgaucaacacccuuuucgccaguggucucuaccaaacuacggcggccaccuggcucucaauaaccaucuggcgcccgcaguuaccccgcuuuucccuggggaacagauucuguuuuucagaucccacaucccaagcgccggaggucauacggacggcgcuaucgacugcuugcucccccaggaguggauugaacacuuuuaucaagaggccgcaccuucgcagucugauauagcccuggugagguucaucaaucccgacaccgggcgggucuuacuggaggcuaagcuacacaaacagggauuucucacaguggccgcauccggcgaucauccaauugucaugccuacuaacgguuacuuccgauuugaagcgugggugaaucccuucuauacccuggcuccaguugggacaggcucaggacgcagaaggauccaguga

SEQ ID NO: 21641 - RNA, 1611 nt, Artificial Sequence
  derived and/or modified sequence opt3 from VP1__Norovirus_and/or_Norovirus-like__KF806495
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccaucucaccaaggaacgcccccggggagauucuuuggagugcuccucugggaccagauuugaaucccuacuuaagccaccuggcccggauguauaacggcuacgcggguggguucgaaguucaggugguccuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaugacguguucacugucagcugcagaguucugaccaggcccaguccggauuuugacuucauuuuucucgugccucccacaguagaaucccggaccaaaccauucacugugccugucuuaacaguggaggaaaugaccaacucucgcuuucccaucccacuggagaaacuuuucacgggacccagcuccgccuucguugugcagccucagaaugguagauguacuaccgauggcgucuugcuggggacaacucaacuaucagcagugaacauaugcaccuuuaggggagacguaacacauguuagugauaagaccuucgcuaugaaucucgccagcccaaacuggaauaacuacgacccgacggaggacauucccgcuccucugggcacuccagauuuugugggucggauccacgggaugcuuacacagaccacucgccgagacggagccacaagaggccauaaggcaaccgucucuacgggcggggccgauuucacccccaagcugggauccgugagguauauuacagacacuaccgaugacuuggaaguccgggagaauacaaaauuuacuccuaucggugugcuccacucaagcggcgaacaccgugcugagccagaucaguggcgccugcccgaauacagugggagaaacguucauaaugugcacuuagcgccggcaguagccccuaccuucccaggagagcagcugcucuuuuucaggucugcccuucccggcugugguggguacccuaacacagaccuggauugcuugcuaccccaagaguggguccagcauuuuuaucaggaagcugcaccagcccaauccgacguggcucugcuccgguucguuaauccugauaccggccgagugcuguuugaguguaaacuucacaagagcggauacgucacuguggcccacacgggcccccaugaccugguaaucccaccgaacggguauuuccgcuuugacucgugggugaaucaguucuacacauuggcaccuaugggaaacgguaccggcagaaggcgguga

SEQ ID NO: 21642 - RNA, 1611 nt, Artificial Sequence
  derived and/or modified sequence opt3 from VP1__Norovirus_and/or_Norovirus-like__KF806503
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccaucucaccaaggaacgcccccggggagauucuuuggagugcuccucugggaccagauuugaaucccuacuuaagccaccuggcccggauguauaacggcuacgcggguggguucgaaguucaggugguccuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaauuaucaaguugauugcuaugcucuauaccccacugcgugccaacaaugcgggggaugacguguucacagucagcugcagaguucugacuaggcccaguccggauuuugacuucaucuuucucgugccucccaccguagaaucccggacaaaaccauucaccgugccugucuuaacuguggaugagaugacaaacucucgcuuucccauaccacuggaaaaacuuuucaccggacccagcuccgccuucguugugcagccucagaaugguagauguacgacugacggcgucuugcuggggaccacacaacuaucagcagugaacauuugcacuuuuaggggagauguaacccauguuagugacaagacauucgcuaugaaucucgccagcccaaacuggaauaacuacgacccgaccgaggagauccccgcuccucugggcacgccagauuuugugggucggauucacgggaugcuuacucagacaacccgccgagacggagccacuagaggccauaaggcaacagucucuaccggcggggccgauuucacgcccaagcugggauccgugagguauaucaccgacacaacugaugacuuggaaguccgggagaauaccaaauuuacaccuaucggugugcuccacucaagcggcgaacaccgugcugagccagaucaguggcgccugcccgaauacagugggagaaacguucauaaugugcacuuagcgccggcaguagccccuacuuucccaggagagcagcugcucuuuuucaggucugcccuucccggcugugguggguacccuaacaccgaccuggauugcuugcuaccccaagaguggguccagcauuuuuaucaggaagcugcaccagcccaauccgacguggcucugcuccgguucguuaauccugauacaggccgagugcuguuugaguguaaacuucacaagagcggauacgucaccguggcccacacuggcccccaugaccugguaauuccaccgaacggguauuuccgcuuugacucgugggugaaucaguucuacacguuggcaccuaugggaaacgguacaggcagaaggcgguga

SEQ ID NO: 21643 - RNA, 1611 nt, Artificial Sequence
  derived and/or modified sequence opt3 from VP1__Norovirus_and/or_Norovirus-like__KF712506
augaagauggccagcuccgacgcuaaccccucugauggcucaaccgcaaaucuggugccugaggccaacaaugaagucauggcgcucgagccaguugugggggcugccaucgcagccccgguagcuggacagcaaaacgugauugaccccuggauaagaaauaacuucguccaggcaccugguggcgaauuuacagugaguccaaggaaugcccccggggagguucuuuggagcgcuccucugggaccagauuugaaccccuacuuaucccaccuggcccggauguauaauggcuacgcggguggguucgaagugcaggucauccuagcaggaaacgccuuugcugccggcaaaauuaucuucgcagcugugccuccaaauuuuucuacugagggccucucgccgucacagguaacgauguucccccaucugauuguugacgugcgccaacuugagccugucaugaucccacugcccgauauacgaaacaauuuuuaucacuacaaccagagcaaugacccuaccaucaaguugauugccaugcucuauacaccacugcgugcgaacaacgugggggaugacguguucacugucaguugcagaguucugaccaggcccuccccggauuuugacuucaucuuucucgugccucccacaguagaaucuaaaaccaauccauucagcgugccuauuuuaacuaucgaggaaaugacaaacucccgguuucccauaccacuggagaaacuuuucaccggacccucaagugccuuggucgugcagccucagaauggucgcuguacgacugauggcguucugcuagggaccacacaacucagcccagugaacauuugcacuuucagaggagacgucacccauacaaccaagacgcacacuuaccagaugaaucuggcagcucagaacuggaacucuuaugauccgacagaggaaauccccgccccucuuggcaccccagacuuuguggguaagauucaggggguacugacucaaacaaccaaggagaauggauccacgagggcucauaaagccaccguuuacacaggcacuguggaguucacccccaaguugggccggauccagcucuuuacagacacugauaaugaccuggaagcaaaccagaauaccaaauucacaccugucggggugauccaagauggagaccaccagaacgaaccacagcagugggucuuacccucauacagcggucgcaauaaccacaaugugcaucuggccccggcuguugcgccuaccuuuccaggcgagcaacuccuuuucuuucgaaguacuaugcccggguguucuggauauccuaacaugaaccuggauugcuugcuaccccaggagugggugcaguacuucuaucaggaagcagccccagcucaauccgacguagcccugcucagauuugucaauccugauacgggcagggugcuguucgaguguaaacuucacaagagcgguuacguuacaguggcacauaccgggcaccacgaccuggucauucccccaaacggcuauuuucgguucgauucgugggugucuccguuuuacacuuuggccccuaugggaaauggcaccgggcgucgcagauga

SEQ ID NO: 21644 - RNA, 1611 nt, Artificial Sequence
  derived and/or modified sequence opt3 from VP1__Norovirus_and/or_Norovirus-like__KF712507
augaagauggccagcuccgacgcuaaccccucugauggcucaaccgcaaaucuggugccugaggccaacaaugaagucauggcgcucgagccaguugugggggcugccaucgcagccccgguagcuggacagcaaaacgugauugaccccuggauaagaaauaacuucguccaggcaccugguggcgaauuuacagugaguccaaggaaugcccccggggagguucuuuggagcgcuccucugggaccagauuugaaccccuacuuaucccaccuggcccggauguauaauggcuacgcggguggguucgaagugcaggucauccuagcaggaaacgccuuugcugccggcaaaauuaucuucgcagcugugccuccaaauuuuucuacugagggccucucgccgucacagguaacgauguucccccaucugauuguugacgugcgccaacuugagccugucaugaucccacugcccgauauacgaaacaauuuuuaucacuacaaccagagcaaugacccuaccaucaaguugauugccaugcucuauacaccacugcgugcgaacaacgugggggaugacguguucacugucaguugcagaguucugaccaggcccuccccggauuuugacuucaucuuucucgugccucccacaguagaaucuaaaaccaauccauucagcgugccuauuuuaacuaucgaggaaaugacaaacucccgguuucccauaccacuggagaaacuuuucaccggacccucaagugccuuggucgugcagccucagaauggucgcuguacgacugauggcguucugcuagggaccacacaacucagcccagugaacauuugcacuuucagaggagacgucacccauacaaccaagacgcacacuuaccagaugaaucuggcagcucagaacuggaacucuuaugauccgacagaggaaauccccgccccucuuggcaccccagacuuuguggguaagauucaggggguacugacucaaacaaccaagggaaauggcuccacgagggcucauaaagccaccguuuacacaggcacuguggaguucacccccaaguuggggcggauccagcucuuuacagacacugauaaugaccuggaagcaaaccagaauaccaaauucacaccugucggagugauccaagauggugaccaccagaacgagccacagcagugggucuuacccucauacagcggccgcaauaaccacaaugugcaucuggccccggcuguugcgccuaccuuuccaggggaacaacuccuuuucuuucgaaguacuaugcccggauguucuggcuauccuaacaugaaccuggauugcuugcuaccccaggagugggugcaguacuucuaucaggaggcagccccagcucaauccgacguagcccugcucagauuugucaauccugauacggguagggugcuguucgaauguaaacuucacaagagcggguacguuacaguggcacauaccggccaccacgaccuggucauucccccaaacggauauuuucgguucgauucgugggugucuccguuuuacacuuuggccccuaugggcaaugggaccggacgucgcagauga

SEQ ID NO: 21645 - RNA, 1611 nt, Artificial Sequence
  derived and/or modified sequence opt3 from VP1__Norovirus_and/or_Norovirus-like__JX401281
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggaguaugccucugagcccagaauugaaucccuacuuaucccaccugucucggauguauaacggauacgcuggcgguuucgaggugcaggucauucuagccgggaaugcguuuacagcaggaaaaaucauuuucgccgcuaucccuccaaacuuuccgacugauggccucucgcccucacaggugacgauguucccucauauaaucguagacguucgccaacuggagccagugcuuauuccccugccugauguccgaaauaacuuuuaucacuacaaucaggccaacgacagcaccuugaagcucaucgcaaugcuguauacaccacugcgugcuaacaaugccggcgaugacguguucacugugaguugcagaguccucaccaggcccuccccggauuuugacuucaucuuuuuaguuccucccacaguggaaucucggaccaaaccauucacuguaccuauucugacaguggaugagaugaccaacagccgcuuucccacgccacuugaaaaguugcauacugggcccaauaacuccauagucgugcagccucagaauggaagauguaccauugacgguguucugcuaggcacaacucaacucucaaccgugaacaucugcaauuucagggggaguacaacccgggcgggacagagccacgccuacacgaugaaccuggucucucagaauuggaacaauuaugauccaacugaggagauuccggcaccccuuggcacaccugacuucguggguaaaaucguagggaugcugucccagaccacucgcgaaaacucaagcacacgagcucauaaggccaccguuaguacgggagacgcucacuuuaccccaaagucuggcuccguguuguucacaacugauaccgacgaucuccaaaauggccagaacacaagauuuacucccgucgggguggcccaggacggagagccucaccaaaaugaaccacagcaguggaggcugcccaacuacagcgguaccccgggccauaacguccacuuagcaccuccaguggcccccacauucccuggggagcagcugcucuuuuuccggucgaccaugcccggauguggcgguuacccaaauauggaucuugacugccuguugccucaagaauggguucgucauuuuuaucaggaggcugcgcccgcacagucugauguggcccuacugcgcuucguaaacccagacacugggagaguccucuuugaguguaaacugcacaaggcuggcuacaucacggugucccacacaggaccguaugaucuuguuauuccucccaauggcuacuucagguuugacucaugggugaaccaguucuaugcccuggcaccaauggggaccggaacuggucggcgacgcuga

SEQ ID NO: 21646 - RNA, 1611 nt, Artificial Sequence
  derived and/or modified sequence opt3 from VP1__Norovirus_and/or_Norovirus-like__KF806526
augaagauggccagcaacgacgcuucccccucugauggcucagcagccaaucuggugccugaggucaacaaugaaguuauggcgcucgagccagugguaggggcugccaucgcagccccgguggcuggacagcaaaacgucauugaccccuggauaagaaauaaauucgugcaggcaccugguggcgaauuuaccguuaguccaaggaacgcccccggggagauccuuuggagcgcuccucugggaccagauuugaaucccuacuuaucccaccuggcccggauguauaacggcuacgcggguggguucgaagugcaggucauucuagcaggaaaugccuuuacagcuggcaagaucauuuucgccgcagugccuccaaacuuuccgacugagggccucucucccucgcagguaacgauguucccucauaucguuguggacguccgccaacuggagccagugcuuauaccccugccugaugugcgaaauaacuuuuaucacuacaaucagucaaaagacccaaccaucaaguugauugcuaugcucuauacaccccugcgugccaacaaugcgggggaagaugucuucacuguuagcugcagagugcugaccaggccgaguccugacuuugauuucaucuuucucguacccccaacaguggagucccggucuaaaccuuucaccguccccauuuuaacuguggaagagaugacaaacagccgcuuuccaaucccccuggagaagcuguucaccggaccuuccggugccuucguugugcagccacagaacggcagauguacgacugacggggucuugcugggaaccacacaacuaucaccggugaauauaugcacuuuuaggggcgaucucacccauuucgcagguacacacgaauacgcuaugaaccuggccagucagaauuggaacaauuaugaccccaccgaggaaauuccugcuccacuuggggcccccgauuuuguaggaaagauccggggcguucugacgcagacuacacgccgagacggcagcaccagagggcauagggcaacuuugucuacaggauccgcccacuucaccccuaaacucgguucaauucgguuuagcacggacaccaacaaugauuucgaggcuggccagaacacaaaguuuacuccagugggggucuuccaagacggagauaaucaccagaacgaaccccagcaaugggugcugccgaauuacaguggcgcgaccgcacauaacguccacuuagccccugcuguggccccagcauuucccggugagcagcuucucuucuuucguucuacaaugccuggguguuccggcuaccccaauaugaaccuugacugccuguugccacaggaguggguucagcauuucuaucaagaagccgcuccugcccagagcgauguggcacuacugcgcuuuguaaaucccgacacuucgagaguccucuucgaguguaaacugcacaagucuggauacgugaccguugcgcacacaggccagcaugaucuugugaucccaccgaacggguauuucagguuugacuccugggucaaccaguucuacacccuggcuccuaugggaaaugguacuggccggcgauga

SEQ ID NO: 21647 - RNA, 1611 nt, Artificial Sequence
  derived and/or modified sequence opt3 from VP1__Norovirus_and/or_Norovirus-like__KF806500
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucaucgaccccuggauaagaaacaauuucgugcaggcaccugguggcgaauuuaccaucucaccaaggaacgcccccggggagauucuuuggagugcuccucugggaccagauuugaaucccuacuuaagccaccuggcccggauguauaacggcuacgcggguggguucgaaguucaggugguccuagcaggaaaugccuuuacagcuggcaaagugaucuucgccgcaguaccuccaaacuuuccgacugagggccucucccccucucagguuacgauguucccucauauuaucguggacguccgccaacuggagccagugcuuauaccccugccugaugugcgaaauaacuuuuaucacuacaaucagucgaacgacucaaccaucaaguugauugcuaugcucuauacaccacugcgugccaacaaugcgggggaugacgucuucacuguuagcugcagagugcugaccaggcccaguccggauuuugacuucaucuuucucguaccucccacaguggaaucccggaccaaaccauucucugucccuguguuaacuguugaggaaaugacaaacagccgcuuucccauuccacuggagaaacuuuucaccggacccuccucagccuucgugguccagccucagaaugguagauguacgacugauggcguguugcuggggaccacacaacuaagugcaguaaacaucugcacuuuuaggggagacguuacccauguggcuggcgauacauucgccaugaaucucgcuagccugaacuggaauaacuacgacccaaccgaggaaacgccggcaccccuugguacuccugacuuugucgggcggauacacggaaugcugacacagaccacucgcucugauggcgccacacgagcccauaaggcuaccguguccacgggcggggcggacuucaccccaaaguugggaucagucagauauagcacagauaccaguucugaccucgaggugagggaaaauacuaaguuuacacccauugguguucugcacuccagcggcgggcaccgggcagagccugaucaguggcguuuaccagaauacucgggacgcaacgugcauaauguacaccuggcccccgcugucgccccgacuuucccuggcgagcagcuccuguuuuucagaucuaccaugccagguugugggggcuaccccaacauggaccuugauugcuugcuaccucaagagugggugcagcauuuuuaucaggaagcagcccccgcucaauccgacguugcccugcucagguucgugaauccagauacaggacggguccuguuugaguguaaacuucacaagucaggcuacgugaccguagcacacacugggccucaugaccuggugauucccccaaacggauauuuccgauuugauaguuggguuaaucaguucuacacguuggcgccgauggguaacggcacagggcgcagaagguga

SEQ ID NO: 21648 - RNA, 1611 nt, Artificial Sequence
  derived and/or modified sequence opt3 from VP1__Norovirus_and/or_Norovirus-like__KF806498
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccaucucaccaaggaacgcccccggggagauucuuuggagugcuccucugggaccagauuugaaucccuacuuaagccaccuggcccggauguauaacggcuacgcggguggguucgaaguucaggugguccuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaaggacucaaccauuaaauugaucgcuaugcucuauacaccacugcgugccaacaacgcgggggaugacguguucacugucagcugcagaguucugaccaggcccaguccggauuuugacuucauuuuucucgugccucccacaguagaaucccggaccaagccauucucugugccugucuuaacuguggaggaaaugacaaauagccgcuuucccaucccacuggagaaacuuuucaccggacccuccucagccuucguugugcagccucagaacgguagauguacgacugauggcgucuugcuggggaccacacaacuaagugcagugaauauaugcacuuuuaggggagacguaacccauguugcuggcgauacauucgccaugaaccucgcuagccugaauuggaacaauuacgacccaaccgaggaaacgccggcaccccuugguacuccugacuuuguggggcggauucacggaaugcugacacagaccacucgcucugauggcgccacacgagcccauaaggcuaccgucuccacgggcggggcggacuucaccccaaaguugggaucagugagauauagcacagauaccaguucugaccucgaggucagggaaaacacuaaauuuacacccaucggugugcugcacuccagcggcgggcaccgggcagagccugaucaguggcguuuaccagaauacucgggacgcaauguucauaacgugcaccuggcccccgcuguagccccgacuuucccuggcgagcagcuccuguuuuucagaucuaccaugccagguugugggggcuaccccaauauggaccuugauugcuugcuaccucaagaguggguccagcauuuuuaucaggaagcagcccccgcucaauccgacguggcccugcucagguucguuaacccagauacaggacgggugcuguuugaguguaaacuucacaagucaggcuacgucaccguggcacacacugggccucaugaccugguaauucccccaaauggauauuuccgauuugauaguugggugaaccaguucuacacguuggcgccgauggguaauggcacagggcgcagaagguga

SEQ ID NO: 21649 - RNA, 1611 nt, Artificial Sequence
  derived and/or modified sequence opt3 from VP1__Norovirus_and/or_Norovirus-like__KF429768
augaagauggccagcuccgacgcuaaccccucugauggcucaaccgcaaaucuggugccugaggccaacaaugaagucauggcgcucgagccaguugugggggcugccaucgcagccccgguagcuggacagcaaaacgugaucgaccccuggauaagaaauaacuucguccaggcaccugguggcgaauuuacagugaguccaaggaaugcccccggggagguucuuuggagcgcuccucugggaccagauuugaaccccuacuuaucccaccuggcccggauguauaauggcuacgcggguggguucgaagugcaggucauccuagcaggaaacgccuuugcugccggcaaaauuaucuucgcagcugugccuccaaauuuuucuacugagggccucucgccgucacagguaacgauguucccccaucugauuguugacgugcgccaacuugagccugucaugaucccacugcccgauauacgaaacaauuuuuaucacuacaaccagagcaaugacccuaccaucaaguugauugccaugcucuauacaccacugcgugcgaacaacgugggggaugacguguucacugucaguugcagaguucugaccaggcccuccccggauuuugacuucaucuuucucgugccucccacaguagaaucuaaaaccaauccauucagcgugccuauuuuaacuaucgaggaaaugacaaacucccgguuucccauaccacuggagaaacuuuucaccggacccucaagugccuuggucgugcagccucagaauggucgcuguacgacugauggcguucugcuagggaccacacaacucagcccagugaacauuugcacuuucagaggagacgucacccauacaaccaagacgcacacuuaccagaugaaucuggcagcucagaacuggaacucuuaugauccgacagaggaaacccccgccccucuuggcacuccagacuuuguggguaagauccaggggguacugacacaaaccacgaagggaaauggcuccaccagggcucauaaagccacaguuuacacuggcaccguggaguucacacccaaguuggggcggauucagcucuuuacugacaccgauaaugaccuggaagcaaaccagaauacaaaauucaccccugucggagugauccaagauggugaccaccagaacgagccacagcagugggucuuacccucauacagcggccgcaauaaccacaaugugcaucuggccccggcuguugcgccuacuuuuccaggggaacaacuccuuuucuuucgaaguacgaugcccggauguucuggcuauccuaacaugaaccuggauugcuugcuaccccaggagugggugcaguacuucuaucaggaggcagccccagcucaauccgacguagcccugcucagauuugucaauccugauacagguagggugcuguucgaauguaaacuucacaagagcggguacguuaccguggcacauacuggccaccacgaccuggucauucccccaaacggauauuuucgguucgauucgugggugucuccguuuuacaccuuggccccuaugggcaaugggacaggacgucgcagauga

SEQ ID NO: 21650 - RNA, 1611 nt, Artificial Sequence
  derived and/or modified sequence opt3 from VP1__Norovirus_and/or_Norovirus-like__KF806496
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccaucucaccaaggaacgcccccggggagauucuuuggagugcuccucugggaccagauuugaaucccuacuuaagccaccuggcccggauguauaacggcuacgcggguggguucgaaguucaggugguccuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaaggacucaaccauuaaauugaucgcuaugcucuauacaccacugcgugccaacaacgcgggggaugacguguucacugucagcugcagaguucugaccaggcccaguccggauuuugacuucauuuuucucgugccucccacaguagaaucccggaccaagccauucucugugccugucuuaacuguggaggaaaugacaaauagccgcuuucccaucccacuggagaaacuuuucaccggacccuccucagccuucguugugcagccucagaacgguagauguacgacugauggcgucuugcuggggaccacacaacuaagugcagugaauauaugcacuuuuaggggagacguaacccauguugcuggcgauacauucgccaugaaccucgcuagccugaauuggaacaauuacgacccaaccgaggaaacgccggcaccccuugguacuccugacuuuguggggcggauucacggaaugcugacacagaccacucgcucugauggcgccacacgagcccauaaggcuaccgucuccacgggcggggcggacuucaccccaaaguugggaucagugagauauagcacagauaccaguggugaccucgaggucagggaaaacacuaaauuuacacccaucggcgugcugcacucuuccggggagcggcgugcagaaccugagcaguggcgcuuaccagaguacagcggaagaaauguucacaacgugcaucuggcccccgcuguagccccgacuuucccuggcgaacagcuccuguuuuucaggucgaccaugccagguugugggggcuaccccaauauggaucuugacugcuugcuaccucaagaguggguccagcacuuuuaucaggaagcagcccccgcucaaucugauguggcccugcuccgguucguuaacccagacacaggacgagugcuguuugaguguaaacuucauaaguccggcuacgucaccguggcacacacugggccucacgaucugguaauucccccaaauggauauuuccgcuuugacucaugggugaaccaguucuacacguuggcgccgauggguaauggcacagggagaaggcgguga

SEQ ID NO: 21651 - RNA, 1611 nt, Artificial Sequence
  derived and/or modified sequence opt3 from VP1__Norovirus_and/or_Norovirus-like__KF806499
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccaucucaccaaggaacgcccccggggagauucuuuggagugcuccucugggaccagauuugaaucccuacuuaagccaccuggcccggauguauaacggcuacgcggguggguucgaaguucaggugguccuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaaggacucaaccauuaaauugaucgcuaugcucuauacaccacugcgugccaacaacgcgggggaugacguguucacugucagcugcagaguucugaccaggcccaguccggauuuugacuucauuuuucucgugccucccacaguagaaucccggaccaagccauucucugugccugucuuaacuguggaggaaaugacaaauagccgcuuucccaucccacuggagaaacuuuucaccggacccuccucagccuucguugugcagccucagaacgguagauguacgacugauggcgucuugcuggggaccacacaacuaagugcagugaauauaugcacuuuuaggggagacguaacccauguugcuggcgauacauucgccaugaaccucgcuagccugaauuggaacaauuacgacccaaccgaggaaacgccggcaccccuugguacuccugacuuuguggggcggauucacggaaugcugacacagaccacucgcucugauggcgccacacgagcccauaaggcuaccgucuccacgggcggggcggacuucaccccaaaguugggaucagugagauauagcacagauaccaguucugaccucgaggucagggaaaacacuaaauuuacacccaucggugugcugcacuccagcggcgggcaccgggcagagccugaucaguggcguuuaccagaauacucgggacgcaauguucauaacgugcaccuggcccccgcuguagccccgacuuucccuggcgagcagcuccuguuuuucagaucuaccaugccagguugugggggcuaccccaauauggaccuugauugcuugcuaccucaagaguggguccagcauuuuuaucaggaaacagcacccgcccaauccgacguggcucugcucagguucguuaacccagauaccggacgggugcuguuugaguguaaacuucacaagucaggcuacgucacuguggcccacacggggccucaugaccugguaauucccccaaauggauauuuccgauuugauaguugggugaaccaguucuacacauuggcaccgauggguaauggcaccgggcgcagaagguga

SEQ ID NO: 21652 - RNA, 1611 nt, Artificial Sequence
  derived and/or modified sequence opt3 from VP1__Norovirus_and/or_Norovirus-like__KF806497
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccaucaguccaaggaaugcccccggggagauucuuuggagcgcuccucugggaccagauuugaaccccuacuuaucccaccuggcccggauguauaauggcuacgcggguggguucgaaguucaggugguccuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaggacagcaccauuaaauugaucgcuaugcucuauacaccacugcgugccaauaacgcgggggaugacguguucacugucaguugcagaguucugaccaggcccuccccggauuuugacuucauuuuucucgugccucccacaguagaaucucggaccaagccauucagcgugccugucuuaacuguggaggaaaugacaaacucccgcuuucccaucccacuggagaaacuuuucaccggacccucaagugccuucguugugcagccucagaaugguagauguacgacugauggcgucuugcuggggaccacacaacuaagcgcagugaacauaugcacuuuuaggggagacguaacccauguugcuggcgauacauucgccaugaaucucgcuucucugaacuggaauaacuacgacccaaccgaggaaacgccggcaccccuugguacuccugacuuuguggggcggauucacggaaugcugacacagaccacucgcuccgauggcgccacacgagcccauaaggcuaccgucucaacgggcggggcggacuucaccccaaaguugggaagcgugagauauaguacagauacuucuuccgaccucgaggucagggaaaauaccaaauuuacacccaucggugugcugcacagcucgggcgggcaccgggcagagccugaucaguggcguuuaccagaauacucuggacgcaacguucauaaugugcaccuggcccccgcuguagccccgacuuucccuggcgagcagcuccuguuuuucagauccaccaugccagguugugggggcuaccccaacauggaccuugauugcuugcuaccucaagaguggguccagcauuuuuaucaggaagcagcccccgcucaaucagacguggcccugcucagguucguuaauccagauacaggacgggugcuguuugaguguaaacuucacaagaguggcuacgucaccguggcacacacugggccucaugaccugguaauucccccaaacggauauuuccgauuugauagcugggugaaucaguucuacacguuggcgccgauggguaacggcacagggcgcagaagguga

SEQ ID NO: 21653 - RNA, 1611 nt, Artificial Sequence
  derived and/or modified sequence opt3 from VP1__Norovirus_and/or_Norovirus-like__JN699046
augaugauggccagcaaggacgcuucccccucugcagauggcgccaacggggcgggacagcuggugccugaggucaauaacgcugaaccacucccgcuugaccccguugccggugcaucaaccgcccuggcuacagcaggccaagugaauaugaucgauccuuggauuuucaacaauuuuguacaggccccacagggggaguucacuauaagucccaacaauacgccuggagacaucuuguuugauuuacagcugggcccacaccuaaaccccuuccucgcucaucugagccaaauguacaaugguuggguggggaacaugagagucagggugauucuugccggaaaugcguuuaccgcaggcaaaguuaucauuugcugugugccuccaggcuuccagucccggacacugucuaucgcccaggcuacuuuguuuccgcacauaaucgccgacguccgcacccucgaacccauugagaucccucuggaagaugugcgaaacacacuguaucauaccaaugacaaccagccaacuaugcgucucuuaugcaugcuguacacaccccuuagaaccgggggagguucgggcgggacggaugcauucguaguugcuggaaggguguugacuuguccuucaagcgacuuuaauuuccuguuucuagucccacccaccguggagcaaaagacacggccguucagugugccuaacauuccccuccagcugcuuuccaacucucgcgucccaaaucugauccagagcaugguuuuguccccugaucaggcccaaaacgugcaguuucagaauggcagaugcacuaccgacggucaacuccuggggacaacccccguaucagugagucagauauuaaaauucaggggaaaggucagcgcgggcucucgggugauuaaccugacggagcucgauggcuccccauuccuugccuuugaagcacccgcuccuacuggguucccagaccugggaacaucagacuggcacguugagaugagcuugaauaguaacucucaguccagcgguaauccgauccuacugcgcgauauucagcccaacucgucugacuuugugccucaucucggcuccgucucagugaccacugccaucgauguagcuggggacuauacaggaaccauccaauggacgagucagccaagcaauguuacccccgugccugaugucaacuucuggacaauuccacaguacggcuccaaucuggccgaagcaucucagcuugcccccguggucuauccgccugguuuuggggaggcuauaguguacuucaugagcccaauccccggcccuaacacugcgcacaaacccaaucugguuccauguuugcucccucaagaguuugugacccacuucguaucagaacaggcacccaguaugggagaggccgcucugguccauuauguggacccagauacaaaccgaaauuuaggcgaauuuaagcuguacccggagggguucauuacuugcguuccuaacggaaccgguccccagcagcuaccacucaacggcguguuugucuucgccuccugggugagcagauuuuaccaacugaagcccguagggacagcaucuucagccagguga

SEQ ID NO: 21654 - RNA, 1611 nt, Artificial Sequence
  derived and/or modified sequence opt3 from VP1__Norovirus_and/or_Norovirus-like__AM263418
augaugauggccagcaaggacgcuucccccucugcagauggcgccaacggggcgggacagcuggugccugaggucaauaacgcugaaccacucccgcuugaccccguugccggugcaucaaccgcccuggcuacagcaggccaagugaauaugaucgauccuuggauuuucaacaauuuuguacaggccccacagggggaguucacuauaagucccaacaauacgccuggagacaucuuguuugauuuacagcugggcccacaccuaaaccccuuccucgcucaucugagccaaauguacaaugguuggguggggaacaugagagucagggugauucuugccggaaaugcguuuaccgcaggcaaaguuaucgugugcugugucccuccaggcuuccagucccggacacugucuauugcccaggcuacuuuguuuccgcacaucauagccgacgugcgcacccucgaacccaucgagauuccucuggaagauguacgaaacacacuguaucauaccaaugacaaccagccaacuaugcgucucuuaugcaugcuguacacaccccuuagaaccgggggagguucgggcgggacggaugcauucguuguggcuggaagggucuugacuuguccuucaagcgacuuuaauuuccuguuucuagugccacccaccguggagcaaaagacacggccguucagugucccuaacaucccccuccagcugcuuuccaacucucgcguuccaaaucugauucagagcaugguguuguccccugaucaggcccaaaacguacaguuucagaauggcagaugcacuaccgacggucaacuccuggggacaacccccgugucagucagucagaucuuaaaauucaggggaaaggugagcgcgggcucucggguuauaaaccugacggagcucgauggcuccccauuccuugccuuugaagcacccgcuccuacuggguucccagaccugggaacaucagacuggcacguggagaugagcuugaauaguaacucucaguccagcgguaauccgauucuacugcgcgauauccagcccaacucgucugacuuugucccucaucucggcuccguggccguaaccacugcuauugauguugccggggacuauacaggaaccauccaauggacgucacagccaaguaaugugacccccgucccugaugugaacuucuggacaaucccacaguacggcagcaaucuggcagaagccucccagcuugcucccgucguguauccgccugguuuuggggaggcgauuguuuacuucaugucuccaauacccggcccuaacacugcacacaaacccaaucuggugccauguuugcucccucaagaguuuguaacccacuucgucagcgaacaggcccccucaaugggagaggcugcccuggugcauuauguugacccagauacaaaccgaaauuuaggcgaauuuaagcuguacccggagggguucaucacuugcgugccuaacggaaccgguccccagcagcuaccacucaacggcgucuuuguguucgcaaguuggguauccagauuuuaccaacugaagcccguggggacagccagcucugcuagguga

SEQ ID NO: 21655 - RNA, 1611 nt, Artificial Sequence
  derived and/or modified sequence opt3 from VP1__Norovirus_and/or_Norovirus-like__KT732278
augaugauggccagcaaggacgcuacccccuccgcagauggcgccaacggggcgggacagcuggugccugaggucaauaacgcugaaccacucccgcuugaccccguugccggugcaucuacagcccuggcuacugcaggccaagugaauaugaucgauccuuggauuuucaacaauuuuguacaggccccacagggggaguucacgauaucacccaacaauaccccuggagacaucuuguuugauuuacagcugggcccacaccuaaaccccuuccucgcucaucugagucaaauguacaaugguuggguggggaacaugagagucagggugauucuugccggaaaugcguuuacagcaggcaaaguuaucauuugcugugugccuccaggcuuccagagccggacucuguccaucgcccaggcuaccuuguuuccgcacauaaucgccgacguccgcacacucgaacccauugagaucccucuggaagaugugcgaaacacccuguaucauacuaaugacaaccagccaacaaugcgucucuuaugcaugcuguacacgccccuuagaaccgggggagguucuggcgggacugaugcauucguaguugcuggaaggguguugaccucgccuucaccagacuuuaauuuccuguuucuagucccuccgacaguggagcaaaagacucggccuuucagcgugcccaacauuccacuccagcugcuuaguaacucccgcgucccuaaucugauccagucuaugguuuugagccccgaucaggcccaaaacgugcaguuucagaauggcagauguaccacagacggucaacuccuggggaccacgccaguauccgugucacagauauuaaaauucaggggaaaggucagugcgggcagcaaagugauuaaccugacugagcucgauggcucucccuuccuugccuuugaagcacccgcuccaacaggguucccggaccugggaaccuccgacuggcacaucgagaugucauugaauagcaacagucagucuuccgguaaucccauucuacugcgggauauccagccuaacagcucggacuuuguuccacaucucggcucuguggccgucacuacagcuaucgauaccgccggggacuauacgggaaccauucaauggacaucccagcccucaaaugugacuccuguaccagauguuaacuucuggaccauaccccaguacggcaguaaucuggcagaagccagccagcuugcuccgguggucuauccuccagguuuuggggaggcgaucguguacuucaugucccccauuccuggccccaacacagcacacaagccaaaucuggucccuugcuugcucccccaagaguuugugacucacuucguuucugaacaggccccaagcaugggagaggcugcccuggugcauuauguagacccggauaccaaccgcaauuuaggcgaauuuaagcuguacccugagggguucaucacauguguccccaacggaaccgguccacagcagcuaccccucaacggcguguuuguuuucgcaucaugggugagucgauuuuaccaacugaaaccugucgggacugccaauuccgcuagauga

SEQ ID NO: 21656 - RNA, 1611 nt, Artificial Sequence
  derived and/or modified sequence opt3 from VP1__Norovirus_and/or_Norovirus-like__KT732277
augaugauggccagcaaggacgcuacccccuccgcagauggcgccaacggggcgggacagcuggugccugaggucaauaacgcugaaccacucccgcuugaccccguugccggugcaucuacagcccuggcuacugcaggccaagugaauaugaucgauccuuggauuuucaacaauuuuguacaggccccacagggggaguucacgauaucacccaacaauaccccuggagacaucuuguuugauuuacagcugggcccacaccuaaaccccuuccucgcucaucugagucaaauguacaaugguuggguggggaacaugagagucagggugauucuugccggaaaugcguuuacagcaggcaaaguuaucauuugcugugugccuccaggcuuccagagccggacucuguccaucgcccaggcuaccuuguuuccgcacauaaucgccgacguccgcacacucgaacccauugagaucccucuggaagaugugcgaaacacccuguaucauacuaaugacaaccagccaacaaugcgucucuuaugcaugcuguacacgccccuuagaaccgggggagguucuggcgggacugaugcauucguaguugcuggaaggguguugaccucgccuucaccagacuuuaauuuccuguuucuagugcccccgacagucgagcaaaagacucggccuuucagcgugcccaacauuccacuccagcugcuuaguaacucccgcgucccuaaucugauccagucuaugguucccagcccagaucaggcccaaaacgugcaguuucagaauggcagauguaccacagacggucaauugcucgggaccacgcccguauccgugucacagauacugaaauucaggggaaaggucagugcgggcagcaaagugauuaacuuaacugagcuggauggcucuccuuuccucgccuuugaagcaccagcuccgacaggguuccccgaccuuggaaccuccgacuggcacaucgagaugucacugaauagcaacagucagucuuccgguaauccuauuuugcuacgggauauccagccaaacagcucggacuuuguuccccaucugggcucuguggccgucacuacagcuaucgauaccgccggggacuauacgggaaccauucaauggacaucccagccuucaaaugugacuccaguacccgauguuaacuucuggaccauaccgcaguacggcaguaaucucgcagaagccagccagcuggcuccuguggucuauccacccgguuuuggggaggcgaucguguacuucauguccccuauucccggcccaaacacagcacacaagccuaaucuuguccccugccuguugccacaagaguuugugacucacuucguuucugaacaggccccgagcaugggagaggcugcccucgugcauuauguagacccugauaccaaccgcaaucugggcgaauuuaaguuauaccccgagggguucaucacaugugucccaaacggaaccgguccccagcagcugccucuaaacggcguguuuguuuucgcaucaugggugagucgauuuuaccaacucaaaccagucgggacugccaauuccgcuagauga

SEQ ID NO: 21657 - RNA, 1611 nt, Artificial Sequence
  derived and/or modified sequence opt3 from VP1__Norovirus_and/or_Norovirus-like__KJ402295
augaugauggccagcaaggacgcucccuccucugcagauggcgccaacggggcgggacagcuggugccugaggucaauaacgcugaaccacucccgcuugaccccguugccggugcaucaaccgcccuggcuacagcaggccaagugaauaugaucgauccuuggauuuucaacaauuuuguacaggccccacagggggaguucacuauaagucccaacaauacgccuggagacaucuuguuugauuuacagcugggcccacaccuaaaccccuuccucgcucaucugagccaaauguacaaugguuggguggggaacaugagagucagggugauucuugccggaaaugcguuuaccgcaggcaaaguuaucauuugcugugugccuccaggcuuccagucccggacacugucuaucgcccaggcuacuuuguuuccgcacauaaucgccgacguccgcacccucgaacccauugagaucccucuggaagaugugcgaaacacacuguaucauaccaaugacaaccagccaacuaugcgucucuuaugcaugcuguacacaccccuuagaaccgggggagguucgggcgggacggaugcauucguaguugcuggaaggguguugacuuguccuucaagcgacuuuaauuuccuguuucuagucccacccaccguggagcaaaagacacggccguucagugugccuaacauuccccuccagcugcuuuccaacucucgcgucccaaaucugauccagagcaugguuuuguccccugaucaggcccaaaacgugcaguuucagaauggcagaugcacuaccgacggucaacuccuggggacaacccccguaucagugagucagauauuaaaauucaggggaaaggucagcgcgggcucuaaagugauuaaccugacggagcucgauggcuccccauuccuugccuuugaagcacccgcuccuacuggguucccagaccugggaacaucagacuggcacguugagaugagcuugaauaguaacucucaguccagcgguaauccgauccuacugcgggauauucaucccaacucgucugaauuugugccucaccucggcuccgucugugugaccgccgcuaucgagguagccggggacuauacuggaacaauccaguggaccucacaaccaaguaauguuacgcccgugccugaugucaacuucuggaccauuccacacuacggcagcaaucuggcagaggccucccagcuugcucccguggucuauccgccugguuuuggggaagcgauaguguacuucaugucuccaauccccggcccuaacacagcacauaagcccaaucugguuccaugcuugcucccucaggaguuugugacucacuucguaagcgaacaggcccccucaaugggagaggcugcccugguccauuauguggacccagauaccaaccgcaauuuaggcgaauuuaagcuguacccggagggguucauuacauguguuccuaacggaacugguccccaacagcuaccacucaacggcguguuugucuucgcaaguugggugucccgauuuuaccagcugaaacccguagggaccgccagcucugcuagauga

SEQ ID NO: 21658 - RNA, 1611 nt, Artificial Sequence
  derived and/or modified sequence opt3 from VP1__Norovirus_and/or_Norovirus-like__AF414406
augaugauggccagcaaggacgcuucccccucugcagauggcgccaacggggcgggacagcuggugccugaggucaauaacgcugaaccacucccgcuugaccccguugccggugcaucaaccgcccuggcuacagcaggccaagugaauaugaucgauccuuggauuuucaacaauuuuguacaggccccacagggggaguucacuauaagucccaacaauacgccuggagacaucuuguuugauuuacagcugggcccacaccuaaaccccuuccucgcucaucugagccaaauguacaaugguuggguggggaacaugagagucagggugauucuugccggaaaugcguuuaccgcaggcaaaguuaucgugugcugugucccuccaggcuuccagucccggacacugucuauugcccaggcuacuuuguuuccgcacaucauagccgacgugcgcacccucgaacccaucgagauuccucuggaagauguacgaaacacacuguaucauaccaaugacaaccagccaacuaugcgucucuuaugcaugcuguacacaccccuuagaaccgggggagguucgggcgggacggaugcauucguuguggcuggaagggucuugacuuguccuucaagcgacuuuaauuuccuguuucuagugccacccaccguggagcaaaagacacggccguucagugucccuaacaucccccuccagcugcuuuccaacucucgcguuccaaaucugauucagagcauggugccuucccccgaucaggcccaaaacguacaguuucagaauggcagaugcacuaccgacggucaauugcucgggacaaccccagugucagucagucagauccugaaauucaggggaaaggugagcgcgggcucucggguuauaaacuuaacggagcuggauggcucccccuuccucgccuuugaagcuccugcaccaacuggguucccggaccuuggaacaucagacuggcacguggagaugagccugaauaguaacucucaguccagcgguaaucccauuuugcuacgcgauauccagccuaacucgucugacuuugucccacaucugggcuccguggccguaaccacugcuauugauguugccggggacuauacaggaaccauccaauggacgucacagcccaguaaugugaccccugucccagaugugaacuucuggacaaucccccaguacggcagcaaucucgcagaagccucccagcuggcuccggucguguauccuccagguuuuggggaggcgauuguuuacuucaugucucccauaccuggccccaacacugcacacaaaccaaaucuugugccucgacuguugccccaagaguuuguaacccacuucgucagcgaacaggccccaucaaugggagaggcugcccucgugcauuauguugacccggauacaaacagaaaucugggcgaauuuaaguuauacccugagggguucgugacuuguaugcccaacggaaccgguccacagcagcugccccuaaacggcgucuuuguguucgcaaguuggguauccagguuuuaccaacucaagccuguggggacagccagcucugcucgguga

SEQ ID NO: 21659 - RNA, 1611 nt, Artificial Sequence
  derived and/or modified sequence opt3 from VP1__Norovirus_and/or_Norovirus-like__AB039774
augaugauggccagcaaggacgcuacccccuccgcagauggcgccaacggggcgggacagcuggugccugaggucaauaacgcugaaccacucccgcuugaccccguugccggugcaucuacagcccuggcuacugcaggccaagugaauaugaucgauccuuggauuuucaacaauuuuguacaggccccacagggggaguucacgauaucacccaacaauaccccuggagacaucuuguuugauuuacagcugggcccacaccuaaaccccuuccucgcucaucugagucaaauguacaaugguuggguggggaacaugagagucagggugauucuugccggaaaugcguuuacagcaggcaaaguuaucauuugcugugugccuccaggcuuccagagccggacucuguccaucgcccaggcuaccuuguuuccgcacgucauagccgacgugcgcacacucgaaccccuggagaucccucuggaagauguacgaaacacccucuaucauaauaacgacucucagccaacuaugcguuuacugugcaugcuuuacacacccuugagaaccgggggagguucgggcgggacggaugcauucguuguggcuggaaggguccugacuuguccuucaccagacuuuaauuuccuauuucucgugcccccgaccguggagcaaaagacacggccuuucagcguccccaacauuccacugcagaaccuuaguaauucccgcguuccuucucugauccagagcaugguguuguccaacgaucacgcccagacuguacaauuucagaauggcagaugcaccacagacggucaucuccuggggaccacgcccgugucagcgggacaguuaaugaaauucaggggcaaggucacaaguggcagcaaagugcugaaccucacugagcuugaugggucuccauuccuggccuuugaagcacccgcuccugccggauucccagacuuggguaagugugacuggcacguugagaugucccuauaucaagauaauaaccacgcugacccgauugugcugcaugccaucgaacccaauucaagcaguuuugucccucaccucggcucuguguccuucaaggagaacguaaauguugcaggggauuacgugugcaccauacaguauacuagcccacccucggacccucauaacccaaaugccgaugucgacuuuuggucuauucccgauuacggauccaaccuggcugaggcgucacagcuugcaccgguggucuauccuccaggcuucggugaagccaucguguacuuuaugagucggguucccggguggaaucgcacaaaccgacugaauuuggugccuugucuccugccccaggaguucauuggccacuuuguaagcgaacaagcuccagccaucggagaggcagccuuacugcacuacgucgacccugauaccaacagaaaccuaggcgaguucaaacucuaucccgaaggguuuaucacgugcgugccaaauggaaccgguccgcagcagcugccucuuaacggcguuuucguguuuuccucuugggucagcagguucuaccaguugaagcccguggggacagcuucacuggcccgguga

SEQ ID NO: 21660 - RNA, 1611 nt, Artificial Sequence
  derived and/or modified sequence opt3 from VP1__Norovirus_and/or_Norovirus-like__KP064095
auggccagcaaggacgcuccccaguccgcagauggcgccucuggggcgggacaacuggugccugaggucaacaccgcugacccacucccgauggaacccguugccgguccuacaacugcaguggccacggcuggccagguaaauaugaucgauccauggauugugaacaauuucguccagucaccccagggggaguuuaccauaaguccuaacaauacaccaggagacauccuuuucgaucugcaauugggcccccacuuaaacccuuuucugagccaucuaucccagauguacaaugguuggguggggaacaugagaguuaggauucuccuggcaggaaaugccuucucugcuggcaaaaucauugugugcugugucccaccgggcuuuacuucgucaagccuuaccaucgcccaggcgacacuguucccccacgugauagcagacguacggaccuuggaaccuaucgagaugccacucgaagauguucgcaacgugcuguaucauacuaaugacaaccagcccacaaugcgacuggucugcaugcucuacaccccuuuacguacugggggagguaguggcaauuccgauucuuuugugguggccgggagaguccugacggcuccaagcuccgacuucucauuucuuuucuugguucccccgaccauugagcaaaagacaagggccuuuacugugccuaacaucccccugcagacccuaaguaauagccgguucccaucucucauucagggaaugauccuguccccugaugcaucacagguagugcaauuucagaacggccgcugucuuauagacggucagcuguuggggacaacccccgcuacgagcggacaacucuucagagucaggggcaaaauuaaccagggcgcccggacucugaauuuaacagagguggaugggaagccauucauggcguuugacagucccgccccuguuggauucccagacuuugguaaaugcgauuggcacaugcgcaucucuaagaccccgaacaauacuuccagcggcgaccccaugcgaucggugucuguccagacaaacgugcagggguucguaccucaucugggauccauucaauuugaugaaguuuucaaucacccaaccggcgacuauaucgguacgaucgaguggauuucacagcccaguaccccuccagggacagauauaaaccucugggaaauccccgacuacggcagcucccuuucucaggcagcuaaucuggccccgccuguguuuccacccggauucggcgaggcuuuggucuauuuugugagcgccuucccugggcccaacaauagaucagcaccaaacgaugucccuugucuacugccccaggaguacauuacucacuuugugagugaacaagccccaaccaugggagacgcugcgcuccugcauuauguugauccggacacaaauaggaaccuuggugaguucaagcuguacccuggcggguacuugacuugcgugcccaauggaguaggcgcagguccacagcagcucccccugaacggggucuuuuuauucguguccuggguuagccgguucuaucagcugaaaccugugggcaccgccucuacagcucguuga

SEQ ID NO: 21661 - RNA, 1608 nt, Artificial Sequence
  derived and/or modified sequence opt3 from VP1__Norovirus_and/or_Norovirus-like__AB045603
augaagauggccagcuccgacgcugcacccucuaacgauggcgccgcggggcuggugccugaggcuaauaacgaaaccauggcccucgagccagucgcaggagccucaaucgcugcaccgcuuacaggucagaauaacauuauagaccccuggaucagacugaauuucguucaagccccuaacggcgaauuuacugugaguccaaggaauagccccggggagguauuguuaaaccuggaacuaggaccugagcucaauccauaccuggcucaccuuucccggauguauaacggcuacgccggugggguggagguccaggugcuguuggcgggaaaugcauucacggccggcaaacucguuuuugcugccgugcccccucauuucccacuggaaaacauuucuccgggccagaucaccauguuuccccacgucauuaucgaugugcgcacacuggagccuguacucuuaccacugcccgacguucgaaauaacuucuuucauuauaaucagcaaaacgaaccucguaugagacuuguggcaauguuguacacuccacugaggucgaacgggucaggagaugacgucuucaccgugagcugccgggugcuaacacgccccaguccggauuuugacuucaauuaucucgucccucccaccguugaguccaagacuaaaccauuuacacugccuauacuuaccaucggugagcugacgaacucuagauuccccgugccaauugaugaauuguacacuagccccaaugagucccucguagugcagccucagaacgggaggugugcucuggacggcgaauuacagggaaccacacaacugcucccaacugccaucugcucauuucggggccgcauuaaucagaaggucaguggugagaaccacguguggaauaugcagguuaccaacaucaaugggacaccguucgaucccaccgaagacgugccugcgccacuuggaacgcccgauuucagcggcaaacuguuuggcgucuugucucagcgagaccaugacaacgccuguagaucccacgaugcagugauagcuacuaauucagccaaguucacaccuaagcuaggggcuauucaaaucggaaccugggaggaggacgauguacacauuaaccagccaacuaaauuuacacccguuggucuguucgaaaaugagggcuuuaaccaguggacccucccgaauuauagcggggcccugacgcuuaacaugggacuggcaccuccaguggcccccaccuucccuggcgaacaaaucuuguuuuucaggagucauaucccccucaaggguggggucgcugacccagugauugauugccuguuaccucaggaguggauacagcaccuguaccaggaaucugcgcccucccaaagcgacgucgcacuaauccgguuuacaaacccagauacuggccguguucucuucgaggccaaacugcaucgcucgggauacauuaccguggcuaauacaggcucuagaccgaucgugguaccugccaacggguauuuuagguucgacuccugggucaaucaguuuuacucacuugcacccaugggaacugguaacggccggcgacgcgugcaguga

SEQ ID NO: 21662 - RNA, 1608 nt, Artificial Sequence
  derived and/or modified sequence opt3 from VP1__Norovirus_and/or_Norovirus-like__AF397905
augaagauggccagcuccgacgcugcacccucuaacgauggcgccgcggggcuggugccugaggcuaauaacgaaaccauggcccucgagccagucgcaggagccucaaucgcugcaccgcuuacaggucagaauaacauuauagaccccuggaucagacugaauuucguucaagccccuaacggcgaauuuacugugaguccaaggaauagccccggggagguauuguuaaaccuggaacuaggaccugagcucaauccauaccuggcucaccuuucccggauguauaacggcuacgccggugggguggagguccaggugcuguuggcgggaaaugcauucacggccggcaaacucguuuuugcugccgugcccccucauuucccacuggaaaacauuucuccgggccagaucaccauguuuccccacgucauuaucgaugugcgcacacuggagccuguacucuuaccacugcccgacguucgaaauaacuucuuucauuauaaucagcaaaacgaaccucguaugagacuuguggcaauguuguacacuccacugaggucgaacgggucaggagaugacgucuucaccgugagcugccgggugcuaacacgccccaguccggauuuugacuucaauuaucucgucccucccaccguugaguccaagacuaaaccauuuacacugccuauacuuaccaucggugagcugacgaacucuagauuccccgugccaauugaugaauuguacacuagccccaaugagucccucguagugcagccucagaacgggaggugugcucuggacggcgaauuacagggaaccacacaacugcucccaacugccaucugcucauuucggggccgcauuaaucagaaggucaguggugagaaccacguguggaauaugcagguuaccaacaucaaugggacaccguucgaucccaccgaagacgugccugcgccacuuggaacgcccgauuucagcggcaaacuguuuggcgucuugucucagcgagaccaugacaacgccuguagaucccacgaugcagugauagcuacuaauucagccaaguucacaccuaagcuaggggcuauucaaaucggaaccugggagcaggacgauguacacauuaaccagccaacuaaauuuacacccguuggucuguucgagaaugaaggcuuuaaccaauggacccucccgaauuauagcggggcccugacgcuuaacaugggacuggcaccuccaguggcccccaccuucccuggcgagcagaucuuguuuuucaggagucauaucccccucaaggguggggucgcugacccagugauugauugccuguuaccucaggaauggauacagcaccuguaccaagagucugcgcccucccagagcgacgucgcacuaauccgguuuacaaacccagauacuggccguguucucuucgaagccaaacugcaucgcucgggauacauuaccguggcuaauacaggcucuagaccgaucgugguaccugccaacggguauuuuagguucgacuccugggucaaucaguuuuacucacuugcacccaugggaacugguaacggccggcgacgcgugcaguga

SEQ ID NO: 21663 - RNA, 1608 nt, Artificial Sequence
  derived and/or modified sequence opt3 from VP1__Norovirus_and/or_Norovirus-like__AF414420
augaagauggccagcuccgacgcugcacccucuaacgauggcgccgcggggcuggugccugaggcuaauaacgaaaccauggcccucgagccagucgcaggagccucaaucgcugcaccgcuuacaggucagaauaacauuauagaccccuggaucagacugaauuucguucaagccccuaacggcgaauuuacugugaguccaaggaauagccccggggagguauuguuaaaccuggaacuaggaccugagcucaauccauaccuggcucaccuuucccggauguauaacggcuacgccggugggguggagguccaggugcuguuggcgggaaaugcauucacggccggcaaacucguuuuugcugccgugcccccucauuucccacuggaaaacauuucuccgggccagaucgcaauguuuccccacgucauuaucgaugugcgcacccuggagccuguacucuuaccacugcccgacguucgaaauaacuucuuucauuauaaucagcaaaacgaaccucguaugagacuuguggcuauguuguacacaccacugaggucgaacgggucaggagaugacgucuucacugugagcugccgggugcuaacccgccccaguccggauuuugacuucaauuaucucgucccucccacaguugaguccaagaccaaaccauuuacucugccuauacuuacaaucggugagcugaccaacucuagauuccccgugccaauugaugaauuguacacgagccccaaugagucccucguagugcagccucagaacgggagguguguccuggacggcgaauuacagggaacuacccaacugcucccaacagccaucugcucauuucggggccgcauuaaucagaaggugaguggugagaaccacguuuggaauaugcaagugacuaacaucaaugggaccccguucgaucccacagaagacgucccugcgccacuuggaacccccgauuucagcggcaaacuguuuggcguguugucucagcgagaccaugacaacgccuguagaucccacgaugcaguaauagcuacuaauucagccaaguucacgccuaagcuaggggcuauucagaucggaacaugggaggaggacgauguucacauuaaccagccaaccaaauuuacucccgugggucuguucgaaaaugagggcuuuaaccaguggacacucccgaauuauagcggggcccugacccuuaacaugggacuggcaccuccagucgcccccacguucccuggcgaacaaaucuuguuuuucaggagucauaucccccucaagggugggguggcugacccagucauugauugccuguuaccucaggaguggauacagcaccuguaccaggaaucugcgcccucccaaagcgacguggcacuaauccgguuuaccaacccagauacaggccguguucucuucgaggccaaacugcaucgcucgggauacauuacuguggcuaauaccggcucuagaccgaucguagucccugccaacggguauuuuagguucgacuccugggugaaucaguuuuacucacuugcacccaugggaacagguaacggccggcgacgcguucaguga

SEQ ID NO: 21664 - RNA, 1608 nt, Artificial Sequence
  derived and/or modified sequence opt3 from VP1__Norovirus_and/or_Norovirus-like__AF427119
augaagauggccagcuccgacgcugcacccucuaacgauggcgccgcggggcuggugccugaggcuaauaacgaaaccauggcccucgagccagucgcaggagccucaaucgcugcaccgcuuacaggucagaauaacguuauugaccccuggauaagacugaauuucgugcaagccccuaacggcgaauuuacuguaaguccaaggaauagccccggggagaucuuguuaaaccuggaacuaggaccugagcucaauccauaccuggcucaccuuucccggauguauaacggcuacgccggugggguggagguccaggugcuguuggcgggaaaugcauucacggccggcaaacucguuuuugcugccgugcccccucauuucccacuggaaaacauuucuccgggccagaucaccauguuuccccacgucauuaucgaugugcgcacacuggagccuguacucuuaccacugcccgacguucgaaauucguucuuucauuauaaccagcaaaaugaaccucguaugagacuuguggcaauguuguacacuccacugaggucaaacgggagcggagaugacgucuucaccgugaguugccgggugcuaacacgccccuccccggauuuugacuucaacuaucucgucccucccaccguugagucuaagacuaaaccauuuacacugccuauacuuaccaucggugagcugacgaauagcagauuccccgcuccaauugaugaauuguacacuucccccaacgagucacucgugguacagccucagaaugggaggugugcccuggacggcgaauuacagggaaccacacaacugcucccaacugcgaucugcaguuuucggggccgcauuaaccagaaggugagcggugagaaucacaucuggaacaugcaggucaccaauacaaacgggaccccguucgaucccacggaagacgugccugccccacuuggaacucccgauuucucuggccgacuguuuggcguuuugucccagagagaccaugacaaugcauguaggucacacgaugcugugauagccacaaacagcgcuaaauucaccccuaagcuaggggccauucaaaucggaacuugggaggaggacgauguccacauuaaucagccaacaaaguuuacccccgugggucuguucgaacauggcgacuuuaaccaguggacgcucccgaauuauaguggggcacugacccuuaacaugggacuggccccuccaguagcucccacauucccuggcgagcaaaucuuguuuuuccggucucacaucccccucaaaggugggguugcggauccagugauugacugccuguuaccucaggaauggauacagcaucuguaccaggaguccgcacccagccaaucggaugucgcccuaauccguuuuacuaauccagacaccggccgcguccucuucgaagcuaagcugcacagaucuggauacauuacaguggccaacacuggcuccaggccgaucgugguuccugcaaacggguauuuucgguucgauucaugggugaaucaguuuuacagucuugcccccaugggaaccgguaacggccgacgcagaguacaguga

SEQ ID NO: 21665 - RNA, 1608 nt, Artificial Sequence
  derived and/or modified sequence opt3 from VP1__Norovirus_and/or_Norovirus-like__AB044366
augaagauggccagcuccgacgcugcacccucuaacgauggcgccgcggggcuggugccugaggcuaauaacgaaaccauggcccucgagccagucgcaggagccucaaucgcugcaccgcuuacaggucagaauaacauuauagaccccuggaucagacugaauuucguucaagccccuaacggcgaauuuacugugaguccaaggaauagccccggggagguauuguuaaaccuggaacuaggaccugagcucaauccauaccuggcucaccuuucccggauguauaacggcuacgccggugggguggagguccaggugcuguuggcgggaaaugcauucacggccggcaaacucguuuuugcugccgugcccccucauuucccacuggaaaacauuucuccgggccagaucaccauguuuccccacgucauuaucgaugugcgcacacuggagccuguacucuuaccacugcccgacguucgaaauaacuucuuucauuauaaucagcaaaacgaaccucguaugagacuuguggcaauguuguacacuccacugaggucgaacgggucaggagaugacgucuucaccgugagcugccgggugcuaacacgccccaguccggauuuugacuucaauuaucucgucccucccaccguugaguccaagacuaaaccauuuacacugccuauacuuaccaucggugagcugacgaacucuagauuccccgugccaauugaugaauuguacacuagccccaaugagucccucguagugcagccucagaacgggaggugugcucuggacggggaauuacagggaaccacacaacugcucccaacugccaucugcucauuucggggccgcauuaaucagaaggucaguggugagaaccacguguggaauaugcagguuaccaacaucaaugggacaccguucgaucccaccgaagacgugccugcgccacuuggaacgcccgauuucagcggcaaacuguuuggcgucuugucucagcgagaccaugacaacgccuguagaucccacgaugcagugauagcuacuaauucagccaaguucacaccuaagcuaggggcuauucaaaucggaaccugggaggaggacgauguacacauuaaccagccaacuaaauuuacacccguuggucuguucgaagacggcggguuuaaucaguggacccucccgaacuauagcggagcccugacgcuuaauaugggccuggcaccuccaguggcccccaccuucccuggugagcaaaucuuguuuuucaggagucauaucccccucaagggcggcgucgcugauccagugauugacugccuguuaccucaggaauggauacagcaccuguaccaggagucugcgcccucccaaagcgaugucgcacuaauccgguuuacaaacccagacacuggacguguucucuucgaagccaaacugcaucgcucgggcuacauuaccguggcuaacacagggucuagaccgaucgugguaccugccaauggauauuuuagguucgauuccugggucaaccaguuuuacucacuugcacccauggguacuggcaaugggcggcgacgcgugcaguga

SEQ ID NO: 21666 - RNA, 1608 nt, Artificial Sequence
  derived and/or modified sequence opt3 from VP1__Norovirus_and/or_Norovirus-like__AB032758
augaagauggccagcaacgacgcugcacccuccaaugauggcgccgcggggcuggugccugaggcuaacaaugaaaccauggcccucgagccagucgcaggagccucuaucgcugcaccgcuuacaggucagaacaauauuauagaccccuggaucagacugaacuucguucaagccccuaauggcgaauuuacugugucaccaaggaacagucccggggagguauuguuaaaucuggaacuaggaccugagcucaacccauaccuggcucaccuuagccggauguauaauggcuacgccggugggguggagguccaggugcuguuggcgggaaacgcauucacggccggcaaacucguuuuugcugccgugcccccucauuucccacuggaaaauauuuccccgggccagaucaccauguuuccccacgucauuaucgaugugcgcacacuggagccuguacucuuaccacugcccgacguucgaaacaauuucuuucauuauaaccagcaaaacgaaccucguaugagacuuguggcaauguuguacacuccacugaggucuaaugggucgggagaugacgucuucaccgugucaugccgggugcuaacacgccccagcccggauuuugacuucaacuaucucgucccucccacccuggagaguaagacuaaaccauuuacacuuccuauacugaccaucggugaguugacuaauuccagauuccccguuccaauugaugaacucuacacgucucccaacgagagccuggugguacagccucagaaugggaggugugcuuuagacggggaacugcagggaaccacacaacuccuuccaacugccaucugcuccuuucggggccgcauuaaccagaaggugucaggugagaaucacgucuggaacaugcaagugaccaauaucaacgggacaccguucgaucccaccggagacguuccugcgccacugggcacgcccgauuucaguggcaaauuguuuggggugcuaagccagcgagaccaugacaaugccuguagaucucacgaugcagucauagcuacuaacuccgccaaguucacaccuaagcugggagcuauucagaucgguaccugggaagaggacgaugugcacauuaaucagccaacuaaauuuacacccguaggccucuucgagaacgaaggguuuaaucaguggacccugccgaacuauucaggagcccuuacgcugaacaugggcuuggcaccuccaguugcccccaccuucccuggugagcaaauccucuuuuucaggagccauaucccccugaagggcggcguggcugacccagucauugauugcuuacugccucaggaauggauacagcaccuauaccaggagagugcgcccucucaauccgacguggcacucauccgguuuacaaauccagauacuggacguguccuguucgaagccaaacuucaucgcagcggcuacauuaccguggcuaacacagggucgagaccgaucguugugccugccaauggauauuuuagguucgacacuuggguaaaccaguuuuacucuuuggcacccauggguaccggcaaugggcggcgacgcguccaguga

SEQ ID NO: 21667 - RNA, 1608 nt, Artificial Sequence
  derived and/or modified sequence opt3 from VP1__Norovirus_and/or_Norovirus-like__AB039775
augaagauggccagcuccgacgcugcacccucuaacgauggcgccgcggggcuggugccugaggcuaauaacgaaaccauggcccucgagccagucgcaggagccucaaucgcugcaccgcuuacaggucagaauaacauuauagaccccuggaucagacugaauuucguucaagccccuaacggcgaauuuacugugaguccaaggaauagccccggggagguauuguuaaaccuggaacuaggaccugagcucaauccauaccuggcucaccuuucccggauguauaacggcuacgccggugggguggagguccaggugcuguuggcgggaaaugcauucacggccggcaaacucguuuuugcugccgugcccccucauuucccacuggaaaacauuucuccgggccagaucaccauguuuccccacgucauuaucgaugugcgcacacuggagccuguacucuuaccacugcccgacguucgaaauaacuucuuucauuauaaucagcaaaacgaaccucguaugagacuuguggcaauguuguacacuccacugaggucgaacgggucaggagaugacgucuucaccgugagcugccgggugcuaacacgccccaguccggauuuugacuucaauuaucucgucccucccaccguugaguccaagacuaaaccauuuacacugccuacccuuacgauaggugagcugacuaacucuagauuccccgugccaaucgaugaauuguacaccagccccaaugagucccucguagugcagccucagaacgggaggugugcucuggacggcgaauuacggggaacaacucagcugcucccaaccgccauuugcccguuucgcggccgaaucaaucaaaaggucucaggugagaaccacguguggaauaugcagguuacaaacauuaaugggacccccuucgauccuacggaagacgugccagcgccccuuggaacuccugauuucaguggcaaacuguuuggcgucuugagccagagagaccaugacaacgccuguaggucucacgaugcagugaucgcuacaaauuccgccaaguucaccccaaagcuaggggcuauacagauuggaacuugggaggaggacgauguacacaucaaccaacccacaaaauuuaccccgguuggucuguucgaaaaugagggcuuuaaccaguggacgcucccuaauuauucaggggcccugacccuuaacaugggacuggcaccacccguggccccuacauuccccggcgaacggauuuuguuuuuccguagccauaucccacucaaggguggggucgcugacccugugaucgauugccuguuacaccaggaguggauucaacaucuguaccaggaaagugcgcccucucaguccgacgucgcacuaauacgcuuuacuaacccagauaccggcagaguucucuucgaggccaaacugcacaggagcggauacaucacaguggcuaauacuggcucgcggccgauugugguaccugccaacggguauuuucgauucgacucuugggucaaucaguuuuacucccuugcacccaugggaaccgguaacggccgcagaagggugcaauga

SEQ ID NO: 21668 - RNA, 1608 nt, Artificial Sequence
  derived and/or modified sequence opt3 from VP1__Norovirus_and/or_Norovirus-like__AF414418
augaagauggccagcaacgacgcugcacccuccaaugauggcgccgcggggcuggugccugaggucaacaaugaaaccauggcucucgagccaguugccggagcaucuaucgccgcuccgcuuacaggucagaacaaugugauugaccccuggauaagaaugaacuucguacaagcaccuaauggcgaauuuacugugucaccaaggaacagucccggggagauccuguugaauuuagaacugggaccuggccuaaacccauuccucgcccaccugagccggauguacaaugguuaugcugggggagucgaggugcagguucuucuggccggcaacgcguuuacggcaggcaaauugguguucgccgcuauucccccucauuuuccaaucgagaaucucuccccggggcagauuaccauguucccccacgucaucauagaugugcgcacacuggaaccuguacugcucccauuacccgacguucgaaacaacuuuuuccauuacaaucaggagccugaaccacguaugagacugguggccaugcuuuauacucccuugaggucuaacggaucgggugaugacgucuuuaccgugucaugccgggugcugacacgcccgagcccugauuucgacuuuaauuaccuaguucccccaaccgucgagaguaagacuaaaccuuucacacuccccauccugaccauuggcgagcuuuccaacucuagauuuccagcacccaucgaugaacuguauacgagcccuaaugagggguuggugguacaaccacagaacggaagguccacucucgacggcgaacuguuagguaccacacagcuggugccgucaaauauuuguagucuccgggggcgcaucaacgcucaccuuagcgauaaucagcaucgauggaacaugcaagucacuaaugccaacggaacccccuucgacccuacagaggaugugccagcgccccugggcaccccugacuucuuggccaauauauacggcguuacgucucagagaaacccagacaauacuugcagggcacacgaugggauucuagcuacauggucccccaaguuuaccccgaaacugggaucagugguccucgguacuugggaagaccgggauuucgacaucaaccagccuacacguuuuaccccagugggccuguaugauacggaccacuucaaucagugggcccuucccaacuacagcggggcucugaccuugaacaugaaucucgccccuaguguagcaccccuguuuccaggagagcaauuacuguucuuucgcucucauauuccucuaaagggcgguacauccaacggggccaucgauugucuccugccccaggaguggguucagcacuucuaccaagaaagcgcuccaucgucuacugacguggcgcuuaucagauauaccaauccggauacaggcagggucuuguuugaggcaaagcugcaucggcagggauucauuacuguggccaacuccggcucacgaccuauagucgugcccccaaauggguacuuucgcuucgacaguuggguuaaccaguuuuauagccucgcucccaugggaaccgguaauggcagaaggcgggugcaguga

SEQ ID NO: 21669 - RNA, 1608 nt, Artificial Sequence
  derived and/or modified sequence opt3 from VP1__Norovirus_and/or_Norovirus-like__AF425769
augaagauggccagcaacgacgcugcacccuccaaugauggcgccgcggggcuggugccugaggucaacaaugaaaccauggcucucgagccaguugccggagcaucuaucgccgcuccgcuuacaggucagaacaaugugauugaccccuggauaagaaugaacuucguacaagcaccuaauggcgaauuuacugugucaccaaggaacagucccggggagauccuguugaauuuagaacugggaccugagcuaaacccauuccucgcccaccugagccggauguacaauggcuaugcugguggggucgaggugcagguucuucuggccggaaacgcguuuacggcaggcaaauugguguucgccgcuauucccccucauuuuccaaucgaaaaucucuccccgggccagauuaccauguucccccacgucaucauagaugugcgcacacuggagccuguacugcucccauuacccgacguucgaaacaacuuuuuccauuacaaucaggaaccugagccacguaugagacugguggccaugcuuuauacucccuugaggucuaacgggucgggagaugacgucuuuaccgugucaugccgggugcugacacgcccgagcccugauuucgacuuuaauuaccuaguucccccaaccgucgagaguaagacuaaaccuuucacacuccccauccugaccauuggugaacuuuccaacucuagauuuccagcacccaucgaugagcuguauacgagcccuaaugaaggcuuggugguacaaccacagaacgggagguccacucucgacggagagcuguuaggcaccacacagcuggugccgucaaauauuuguagucuccggggucgcaucaacgcucaccuuagcgauaaucagcaucgauggaacaugcaagucacuaaugugaacgggacccccuucgacccuacagaagauguuccagcuccccugggaaccccugacuucuuggcgaauauauacggcgugacgucucagagaaacccagacaauacuugcagggcccacgauggcauucuagcaacauggucccccaaguuuaccccgaaacuggggucagucgugcucggaacuugggaggaccgggauuucgacaucaaccagccuacacguuuuaccccaguaggucuguaugauacggaccacuucaaucagugggcccuucccaacuacagcggcgcccugaccuugaacaugaaucucgcuccuaguguugcaccccuguuuccaggggagcaauuacuguucuuucgcucucauauuccucuaaagggaggcacauccaacggugccaucgauugucuccugccccaggaaugggugcagcacuucuaccaagagagcgccccaucgucuacugacgucgcucuuaucagauauaccaauccggauacagggaggguguuguuugaagcggagcugcaucggcagggcuucauuacugucgcaaacccuggaucccgacccauagugguuccacccaauggcuacuuucgcuucgacucaugggugaaccaguuuuauagucucgccccuauggggaccggaaaugguagaaggcggguacaguga

SEQ ID NO: 21670 - RNA, 1608 nt, Artificial Sequence
  derived and/or modified sequence opt3 from VP1__Norovirus_and/or_Norovirus-like__AF414421
augaagauggccagcaacgacgcugcacccuccaaugauggcgccgcggggcuggugccugaggucaacaaugaaaccauggcucucgagccaguugccggagcaucuaucgccgcuccgcuuacaggucagaacaaugugauugaccccuggauaagaaugaacuucguacaagcaccuaauggcgaauuuacugugucaccaaggaacagucccggggagauccuguugaauuuagaacugggaccugagcuaaacccauuccucgcccaccugagccggauguacaauggcuaugcugguggggucgaggugcagguucuucuggccggaaacgcguuuacggcaggcaaauugguguucgccgcuauucccccucauuuuccaaucgaaaaucucuccccgggccagauuaccauguucccccacgucaucauagaugugcgcacacuggagccuguacugcucccauuacccgacguucgaaacaacuuuuuccauuacaaucaggaaccugagccacguaugagacugguggccaugcuuuauacucccuugaggucuaacgggucgggagaugacgucuuuaccgugucaugccgggugcugacacgcccgagcccugauuucgacuuuaauuaccuaguucccccaaccgucgagaguaagacuaaaccuuucacacuccccauccugaccauuggugaacuuuccaacucuagauuuccagcacccaucgaugagcuguauacgagcccuaaugaaggcuuggugguacaaccacagaacgggaggccgacucucgacggagagcuguuaggcaccacacagcuggugcccuccaauauuuguucacuccggggucgcaucaacgcucaccuuagugauaaucagcaucgauggaacaugcaagucacuaaugccaacgggaccccuuucgacccaacagaagaugcgcccgccccucugggaaccccagacuucuuggcaaauauauacggcgugacgagccagagaaaccccgacaauacuugcagggcucacgauggcauucuagccacauggucuccgaaguuuaccccuaaacugggguccguugugcucggaacuugggaggaccgggauuucgacaucaaccagccaacacguuuuacccccgucggucuguaugauacggaccacuucaaucagugggcccuuccuaacuacucaggcgcucugaccuugaacaugaaucucgcacccagcguggccccacuguuuccuggggagcaauuacuguucuuucgcagucauauuccccuaaagggaggcacaucuaacggugcuaucgauugucuccugccacaggaauggguacagcacuucuaccaagaguccgcgccgagcucgacugacguugcacuuaucagauauaccaauccugauacagggaggguguuguuugaagccaagcugcaucggcagggcuucauuacugucgcuaacucuggaucccgacccauaguggucccacccaauggcuacuuucgcuucgacucaugggugaaccaguuuuauagucucgccccuauggggaccggaaaugguagaaggcggguucaguga

SEQ ID NO: 21671 - RNA, 1608 nt, Artificial Sequence
  derived and/or modified sequence opt3 from VP1__Norovirus_and/or_Norovirus-like__AF414416
augaagauggccagcaacgacgcugcacccuccaaugauggcgccgcggggcuggugccugaggucaacaaugaaaccauggcucucgagccaguugccggagcaucuaucgccgcuccgcuuacaggucagaacaaugugauugaccccuggauaagaaugaacuucguacaagcaccuaauggcgaauuuacugugucaccaaggaacagucccggggagauccuguugaauuuagaacugggaccugagcuaaacccauuccucgcccaccugagccggauguacaauggcuaugcugguggggucgaggugcagguucuucuggccggaaacgcguuuacggcaggcaaauugguguucgccgcuauucccccucauuuuccaaucggcaaucucuccccggggcagauugccauguucccccacgucaucauagaugugcgcacccuggaaccuguacugcucccauuacccgacguucgaaacaacuuuuuccauuacaaucaggagccugaaccacguaugagacugguggcaaugcuuuauacacccuugaggucuaacggaucgggugaugacgucuuuacugugucaugccgggugcugacccgcccgagcccugauuucgacuuuaauuaccuaguucccccaacagucgagaguaagaccaaaccuuucacucuccccauccugacaauuggcgagcuuuccaacucuagauuuccagugcccaucgaugaacuguauaccagcccuaaugagggguugguagugcaaccacagaacggaagguccacgcucgacggcgaacuguuagguacuacccagcuggucccgucaaauauuuguagucuccgggggcgcaucaacgcucaccuuagcgauaaucagcaucgauggaacaugcaagugacaaaugccaacggaacucccuucgacccuaccgaggauguuccagcgccccugggcacaccugacuucuuggccaauauauacggcgugaccucucagagaaacccagacaauacgugcagggcacacgaugggauucuagcuacuuggucccccaaguuuacaccgaaacugggaucagucgugcucgguaccugggaagaccgggauuucgacaucaaccagccuacucguuuuacaccaguaggccuguaugauaccgaccacuucaaucaguggguucuucccuacuacagcggggcccugacguugaacaugaaccucgcuccuaguguggcaccccuguuuccaggagagcaauuacuguucuuucgcucucaugucccucuaaagggcgguaccuccaauggggccauugauugucuccugccccaggagugggugcagcacuucuaucaagaaagcgccccaucgucuacagacgucgcucuuaucagauacacuaacccggauaccggcaggguguuguuugaggcgaagcugcaucggcagggauucaucacaguugcaaauuccggcucacgaccuauugugguacccccaaacggguauuuucgcuucgacaguugggucaaucaguuuuacagccucgcccccaugggaacugguaacggcagaaggcgggugcaguga

SEQ ID NO: 21672 - RNA, 1608 nt, Artificial Sequence
  derived and/or modified sequence opt3 from VP1__Norovirus_and/or_Norovirus-like__AF414419
augaagauggccagcaacgacgcugcacccuccaaugauggcgccgcggggcuggugccugaggucaacaaugaaaccauggcucucgagccaguugccggagcaucuaucgccgcuccgcuuacaggucagaacaaugugauugaccccuggauaagaaugaacuucguacaagcaccuaauggcgaauuuacugugucaccaaggaacagucccggggagauccuguugaauuuagaacugggaccugagcuaaacccauuccucgcccaccugagccggauguacaauggcuaugcugguggggucgaggugcagguucuucuggccggaaacgcguuuacggcaggcaaauugguguucgccgcuauucccccucauuuuccaaucgaaaaucucuccccgggccagauuaccauguucccccacgucaucauagaugugcgcacacuggagccuguacugcucccauuacccgacguucgaaacaacuuuuuccauuacaaucaggaaccugagccacguaugagacugguggccaugcuuuauacucccuugaggucuaacgggucgggagaugacgucuuuaccgugucaugccgggugcugacacgcccgagcccugauuucgacuuuaauuaccuaguucccccaaccgucgagaguaagacuaaaccuuucacacuccugauccuuaccauuggugaacuguccaacucuagauuucccgcaccaaucgaugaguuguauacgagccccaaugaaggccucgugguacaaccucagaacgggagguccacucuggacggagaguuacugggcaccacacagcucgugccaucaaauauuuguagucuucggggucgcaucaacgcucaccugagcgauaaucagcaucgauggaacaugcaagucacuaaugccaacgggaccccguucgaccccacagaagaugugccugcgccauugggaacccccgacuuccuagccaauauauacggcguuacgucucagagaaacccugacaauacuugcagggcacacgauggcauucuggcuacaugguccccaaaguuuacccccaaacucgggucagugguccugggaacuugggaggaccgggauuucgacaucaaccagccggcccguuuuacaccugugggucuuuaugauaccgaccacuucaaucagugggcucugccaaacuacagcggcgccuugacgcucaacaugaaucuggcacccaguguagccccuuuauuucccggggagcaacugcuauucuuucgcucucauauuccacucaagggaggcaccuccaacggugcuaucgauugucugcuuccucaggaauggguucagcacuucuaccaagagagcgcgcccucgucuacagacguggcauugaucagauauacuaauccagauaccgggaggguccuguuugaagccaagcuccaucggcagggcuucauuacaguggcuaacuccggaucacgaccgauagucgugccucccaauggcuacuuucgcuucgacaguuggguuaaccaguuuuauagccuggccccaauggggacuggaaaugguagaaggcgggugcaguga

SEQ ID NO: 21673 - RNA, 1608 nt, Artificial Sequence
  derived and/or modified sequence opt3 from VP1__Norovirus_and/or_Norovirus-like__AF425767
augaagauggccagcaacgacgcugcacccuccaaugauggcgccgcggggcuggugccugaggucaacaaugaaaccauggcucucgagccaguugccggagcaucuaucgccgcuccgcuuacaggucagaacaaugugauugaccccuggauaagaaugaacuucguacaagcaccuaauggcgaauuuacugugucaccaaggaacagucccggggagauccuguugaauuuagaacugggaccugagcuaaacccauuccucgcccaccugagccggauguacaauggcuaugcugguggggucgaggugcagguucuucuggccggaaacgcguuuacggcaggcaaauugguguucgccgcuauucccccucauuuuccaaucgaaaaucucuccccgggccagauuaccauguucccccacgucaucauagaugugcgcacacuggagccuguacugcucccauuacccgacguucgaaacaacuuuuuccauuacaaucaggauccugaaccacguaugagacugguggccaugcuuuauacucccuugaggucuaacgggucgggagacgaugucuuuaccgugucaugccgggugcugacacgcccgagcccugacuucgauuuuaauuaccuaguucccccaaccgucgagaguaagacuaaaccuuucacacuccccauccugaccauuggugagcuuuccaacucuagauuuccagcacccaucgacgaacuguauacgagcccuaaugagggcuuggugguacaaccacagaacgggggauccacucucgauggcgaacuguuagguaccacacagcuggugccgucaaauauuuguagucucagggggcggaucaacgcucaccuuagcgacaaucagcaucgcuggaacaugcaagucacuaaugugaacggaacccccuucgauccuacagaggacguuccagcuccccugggcaccccugacuucuuggcgaauauauacggcauuacgucucagcgaaacccagauaauacuugcagagcccacgacgggauccuagcaacauggucccccaaguuuaccccgaaacugggaucagugguccucgguacuugggaagauagggacuucgauauuaaccagccuacacgguuuaccccagugggccuguaugacacggaucacuucaaucagugggcccuucccaacuacagcggggcccugaccuugaacaugaaucucgcuccuaguguagcaccccuguuuccaggagagcaauuacuguucuuucguucucauaucccucuaaagggcgguacauccaacggggccaucgacugucuccugccccaggaguggguucagcacuucuaccaagaaagcgccccaucgucuacugauguggcucuuauucgcuauaccaauccggacacaggcagagucuuguuugaggcgaagcugcauaggcagggauucauaacuguggcaaacuccggcucacggccuaucgucgugcccccaaauggguacuuucgauucgauaguuggguuaaccaguuuuauagccucgcccccaugggaaccgguaauggccgcagaagggugcaguga

SEQ ID NO: 21674 - RNA, 1608 nt, Artificial Sequence
  derived and/or modified sequence opt3 from VP1__Norovirus_and/or_Norovirus-like__DQ093065
augaagauggccagcaacgacgcugcacccuccaaugauggcgccgcggggcuggugccugaggucaacaaugaaaugauggcucucgagccaguugccggagcaucuaucgccgcuccgcuuaccggucagaacaaugugauugaccccuggauaagaaugaacuucguacaagcaccuaauggcgaauuuacagugucaccaaggaacagucccggggagauccuguugaauuuagaacugggaccugagcuaaacccauuccucgcccaccugagccggauguacaauggcuaugcugguggggucgaggugcagguucuucuggccggaaacgcguuuacugcaggcaaauugguguucgccgcuauucccccucgcuuuccaaucgaaaaucucuccccgggccagauuacgauguucccccaugucaucauagaugugcgaacccuggagccuguacugcucccauuacccgacguucguaacaacuuuuuccacuacaaucaggaaccugagccaagaaugaggcugguggccaugcuuuauacacccuugcggucuaacgggucgggagaugacgucuuuacugugucaugccgcgugcugaccagaccgagcccugauuucgacuuuaauuaccuaguucccccaacagucgagaguaagaccaaaccuuucacucuccccauccugacaauuggugaacuuuccaacucuagguuuccagcacccaucgaugagcuguauaccagcccuaaugaaggcuuggugguacaaccacagaacgggcgguccacgcucgacggagagcuguuaggcacuacccagcuggugccgucaaauauuuguagucuccgcggucgaaucaacgcucaucuucccgauaaucagcacagauggaacaugcaagucacaaaugccaacgggacuccuuucgacccaaccgaagaugugcccgcgccucugggaacaccagacuucuuggccaauauauacggcguuaccagccagaggaaccccgacaauacgugccgggcacaugauggcauucuagcuacuuggucuccgaaguuuacaccuaaacugggguccgugguccucggaaccugggaggaccgugauuucgacaucaaccagccaacucgcuuuacacccgugggucuguaugauaccgaccacuucaaucagugggcccuuccuaacuacucaggcgcucugacguugaacaugaaucucgcccccagcguagcaccacuguuuccuggggagcaauuacuguucuuuagaagucacauuccccuaaagggaggcaccucuaacggugccaucgauugucuccugccacaggaauggguucagcauuucuaccaagaguccgcuccgagcucgacagacguggcgcuuaucagguauacuaauccugauaccgggcgggucuuguuugaagcaaagcugcaccgacagggcuucauuacaguggccaacucuggaucccgccccauagucgugccacccaauggcuacuuuagauucgacucauggguuaaccaguuuuauagucucgcuccuauggggacuggaaaugguaggcggcgcgugcaguga

SEQ ID NO: 21675 - RNA, 1608 nt, Artificial Sequence
  derived and/or modified sequence opt3 from VP1__Norovirus_and/or_Norovirus-like__KJ194507
augaagauggccagcaacgacgcugcacccuccaaugauggcgccgcggggcuggugccugaggucaacaaugaaaccauggcucucgagccaguugccggagcaucuaucgccgcuccgcuuacaggucagaacaaugugauugaccccuggauaagaaugaacuucguacaagcaccuaauggcgaauuuacugugucaccaaggaacagucccggggagguccuguugaauuuagaacugggaccugagcuaaacccauuccucgcccaccugagccggauguacaauggcuaugcuggugggguggagguucaggugcuucuggccggaaacgcguuuacggcaggcaaauuggucuucgccgcuauucccccucauuuuccacucgaaaaucuguccccgggccagaucaccauguucccccacgugaucauugauguacgcacacuggagccuguucucuuaccacugcccgacgugcgaaacaacuuuuuccauuacaaucagcaaccugaaccacguaugagacuugucgccauguuguauacuccccugaggucuaacgggucgggagaugacguguuuaccgugucaugccggguccuaacacgcccgagcccugauuucgacuuuaauuaccucguucccccaaccguggagaguaagacuaaaccuuucacacugcccauccuuaccauaggugagcuguccaacucuagauuuccaguacccaucgaugaauuguauacgagcccuaaugagggcguggucgugcagccacagaacgggagguccacucucgacggagaacuguuaggcaccacacagcugguuccgucaaauauuugugcacuccggggucgcaucaacgcucaagugcccgaugaccaccaucaguggaaucuucaggucacuaacaccaaugggacaccuuucgauccaaccgaggacgugcccgccccucugggaacgccagacuucuuggcgaacauuuacggcguaacaagucagcgaaaucccaacaauacuugcagagcccacgauggcguucuagcaaccuggagcccgaaguuuacuccuaaacuggggucugugguccucggaacaugggaagaguccgaccuggaucuuaaccaaccaaccagguucacgcccgugggucuguuuaauaccgaccacuucgaucagugggucuugccuaacuauucaggccggcucacacugaacaugaauuuagcucccagcgugaguccacuguuuccuggggagcagauccuauucuuucguucucauauaccccucaagggaggcacuuccgacggugccauugauugucugcuuccacaagaauggauccagcacuucuaccaggagagcgcuccgucgccuaccgacguugccuugauucgcuacacaaaccccgauacugggagagugcuguuugaagcaaagcuccauaggcagggcuucaucaccguagccaauucuggaucccggccaaucgucgugcccccuaacggcuauuuucgauucgacucauggguuaaucaauuuuacagucuggcuccaauggggacaggaaacggucgcagaagggugcaguga

SEQ ID NO: 21676 - RNA, 1608 nt, Artificial Sequence
  derived and/or modified sequence opt3 from VP1__Norovirus_and/or_Norovirus-like__KP064099
augaagauggccagcaacgacgcugcacccuccaaugauggcgccgcggggcuggugccugaggucaacaaugaaaccauggcucucgagccaguugccggagcaucuaucgccgcuccgcuuacaggucagaacaaugugauugaccccuggauaagacugaacuucguacaagcaccuaauggcgaauuuacugugucaccaaggaacagucccggggaggucuuguuaaaucuggaacuaggaccugagcucaacccauaccuggcccaccuuagccggauguauaauggcuacgcuggugggguggagguucaggugcuguuggccggaaacgcguucacggcaggcaaacucgucuuugccgcugugcccccucauuucccacuggaaaauaucuccccgggccagauuaccauguuuccccacguaaucauugauguucgcacacuggagccugugcucuuaccacugcccgacguccgaaacaauuucuuucauuauaaccagcaaaacgaaccucguaugagacuuguggccauguuguacacuccacugaggucuaaugggucgggagaugacguguucaccgucucaugccggguucuaacacgccccagcccggauuuugacuucaacuaucucgugccucccaccguagagaguaagacuaaaccauuuacacugccuauccuuaccauaggugagcugacuaauuccagauuccccgugccaaucgaugaauuguacacgucucccaacgagagccucgucgugcagccucagaaugggaggugugcacuggacggcgaauuacagggaaccacacaacugcucccaacugcuauuugcuccuuucggggccgcaucaaccagaagguuucaggugauaaucacguguggaacaugcaggucaccaauauuaacgggacaccguucgaccccaccgaggaugugccugccccacuuggaacgcccgacuucaguggcaaacuguuuggcguauugagccagcgagaccaugauaaugcguguagaucucacgacgccguuaucgcaacugauuccgcuaaguucacaccuaagcuaggggccauacaaauuggaaccugggaagaggacgaugugcacaucaaccagccaacuaaauuuacacccgucggucuguucgagagggaaggcuuuaaucaguggacccucccgaacuauucaggggcucugacgcuuaauaugggacuggccccuccaguggcacccaccuucccuggcgagcaaauuuuguuuuuccggagccauaucccccucaaggguggggucgccgacccagugaucgauugccuguuaccucaggaauggauucagcaccuguaccaggagagugcucccucucaaacagacguugcgcuaauacguuuuacuaacccagauaccggccgcguacucuucgaagcaaaacugcauagauccggauacaucacaguggccaacacuggcagcaggccgauugucgugccugcuaauggguauuuucgguucgacucguggguuaaccaguuuuacucucuugcccccaugggaaccgguaauggccgacgcagagugcaguga

SEQ ID NO: 21677 - RNA, 1608 nt, Artificial Sequence
  derived and/or modified sequence opt3 from VP1__Norovirus_and/or_Norovirus-like__AB303926
augaagauggccagcaacgacgcuacccccuccgauggcucuacagcaaaucuggugccugaggucaacaaugaaguuauggcccucgagccagugguaggggcggcuaucgccgcaagaguggccggacagcaaaacgucauugacccguggauaaggaauaacuucgugcaggcucccgguggcgaauuuacuguuucaccucggaaugcaccaggggagauccuuuggagugcaccccugggaccugauuugaacccauacuuaagccaccuggcucgcauguauaauggcuacgccgguggguucgaagugcaggucauucuagcgggaaacgcauuuacggccggcaaaaucauuuucgcugccgugcccccuaauuuuccaaccgagggccucuccccgucucagguaacaauguucccccauaucauaguugacgugcgacaacuggagccuguccuuaucccacugcccgaugugcguaacaauuuuuaucacuacaaccagucgaaugacucaacuauuaaguugaucgcaaugcucuauaccccucugagagcuaacaacgccggggaugacguguucacagucagcugcaggguucugacccggccaagucccgauuuugacuucauuuuucucgugccgccuacuguagaaucccgcacaaaacccuucaccgugccaaucuuaacggucgaggaaaugucuaauagcagauuuccugugccccuggagaaacuuuacacuggaccauccucagcguucguugugcagccccagaacgguagguguaccacagauggcgucuugcuggggacuacccaacuaagugccgugaauauaugcacauuccggggagacguaacccauauugcaggcagccacgauuauacgaugaaccucgcuucucagaauuggaacaauuacgacccuacugaggaaaucccagccccgcuggguacacccgacuuuguugggaagauucagggagugcuuacccagacuacacgcgaggauggcuccacccgagcucauaaggccacggucucaaccggcagcgugcacuucacaccuaagcuggggaguguccaauacacuaccgacacaaacaaugauuuucagacuggacagaacaccaaauucacaccaguggguguuauccaagacggcucuaaucaccagaacgaaccccagcaguggguguugccuaauuauuccgggagaaccggacauaacguacaccucgcaccagccgucgcucccacuuuuccgggcgagcaacuguuauucuuuaggagcacgaugccugguuguucgggguacccaaauaugaaccuggauugccuccuuccccaggaaugggugcagcauuucuaucaggaggcggccccugcccaaucugacguugcucuguugcgguuugugaaccccgauacaggccguguccuauucgaguguaagcugcacaaauccggauacgugaccguagcccacacuggcccacaugaccucgugaucccucccaauggguauuuucgcuucgauucauggguuaaccaguuuuacacccuggcaccaaugggaaauggugccggcagauga

SEQ ID NO: 21678 - RNA, 1608 nt, Artificial Sequence
  derived and/or modified sequence opt3 from VP1__Norovirus_and/or_Norovirus-like__KU985166
augaagauggccagcuccgacgcuaaccccucugauggcucaaccgcaagucuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuagcccaaggaacgcacccggggagauccuuugguccgccccucugggaccagauuugaaucccuacuuaucucaccuggcucggauguauaacggcuacgccgguggguucgaagugcaggucauucuagcgggaaaugcauuuacugccggcaaaaucauuuucgcugccgugccuccaaacuuuccgacggagggccucucgcccucacagguaaccauguucccucauaucauaguugacgugcgccaacuggagccaguccuuaucccccugccugaugugcgaaauaacuuuuaucacuacaaucagagcaacgacaguacaauuaaguugaucgcaaugcucuauacuccacugcgugcuaauaacgccggggaugacguguucaccgucuccugcagaguucugacaaggcccucuccggauuuugacuucauuuuucucgugccucccaccguagaaagccggacuaaaccauucuccgugccuaucuuaacagucgaggaaaugaccaacucacgcuuucccauaccacuggagaagcuguucacgggacccaguagcacuuucgugguucagccucagaaugguagauguaccacagauggcguguugcuggggacuacccaacuaucuccagucaacauuugcacauuuaggggaggcaucacccggauuggucaguccgagucauacaaaaugaaucucgcgagccagaacuggaauaacuaugacccgacggaagagauccccgccccucuggggacuccagauuucaagggacgcauccgaggccuucugacacagaccacuaagggcgcagggaguacaagaggacauaaagcuaccguguugacggguggcucugacuuuacccccaagcucgggacaguaagguucgacacuaaauccauugauuuugaaaauaaccaaaauaccaaguucacaccuguuggagugguccaggacggcaacaaucacgaugagccaacucagugggugcugcccaacuacagcgguccggacacccauaauguccacuuagccccugcuguggccccaacauuucccggggaacaacuucucuucuuucggucgaccaugccuggcuguucuggauaccccaaaauggagcuugauugccuguugccacaggaguggguucagcacuucuaucaggaagcagccccugcucaaacugacguggcgcuacugcguuuuguaaaccccgauacgggccgcguccucuucgaguguaagcugcauaaguccggguacgugacaguugcacacaccggagaccaugaucuugugauaccaccgaaugguuauuuuagauucgacucaugggucaaccaguucuacacucuggccccuaugggcaacgggaccggaaggcggcgauga

SEQ ID NO: 21679 - RNA, 1608 nt, Artificial Sequence
  derived and/or modified sequence opt3 from VP1__Norovirus_and/or_Norovirus-like__JN699045
augaugauggccagcaaggacgcucccaccuccccugauggcgcaucuggggccggacagcuggugccagaagcgaacacagcugaacaaaucucaauggacccggucgccggugcaaguacugccguugcuacggcaggccaggugaauaugauugaucccuggauauucaacaauuuuguacaggccccucagggggaguucaccaucagcccaaacaauacacccggagacauucucuuugaucuucaacugggcccucacuugaacccauucuuagcucaucugucccagauguacaaugguuggguggggaacaugagagucaggauccuacucgccggaaaugcguuuacugcaggcaaaauuaucauaugcugugugcccccuggcuucgacgcccggauccugaccauugcucaggccacacuuuuuccacaccugaucgcagauguucgcaccuuggaaccgguggagcucccccuggaagacguccgaaacgugcuguuccauaauucuucgcagccucaaccaacuaugcgucucguagcuauguuauauacaccccugagaaccgggggagguucaggcgggacggaugccuuuguuguggcgggaaggguccuuacuugcccugccccagacuucagcuuuuuguuccuggugcccccgaguguggagcagaagacccgggucuuuuccguuccuaacgugccccuaaaagaucucucuaauagccgcguaccagugccuauucagggcauguucaugucccccgacgucaaccagucagugcaauuccagaaugguagaugucagaucgaugggcaacugcagggaacaacuccaguuagucuuagccagcugugcaagauaaggggcaaaaccucuuccaacgcacggguguugaaccucucagaggucgacggcacacccuuuauuccucuggaaagcccagcuccggugggguuccccgacuuaggagguugugauuggcacguaaauuuuaccuuccaggcccaaaaccaggacccuagucagucuguuacguuugcuacuaaugaugccuccuucgugccauaccugggcagcaucucgccccauaacgggggagacuuucacucuggcgauauuaucgguucccucggguggaucucagcaccuagugacagcucccagcuuaaugucuggacaauuccaaaguauggcucuagccugcccgaugugacccacuuggccccggcugucuucccuccaggauuuggcgaggugauacuauacuuccauucaacuuuucccgggaguggacaaccuggucagcugcagguucccugccuccugccacaggaguucaucacacacuuuuguaacgaacaagcgccuauugcaggcgaggccgcccuucugcauuauguggaccccgauaccgggcgcaauuugggagaguucaagcucuacccagacggcuucaugacgugcguaccgaacuccgucagcucugguccucagacccugcccaucaaugggguguuuguuuucgugucaugggucagucgauuuuaucaguuaaaaccagugggcacagcuagcgcagccagaaggcuguga

SEQ ID NO: 21680 - RNA, 1608 nt, Artificial Sequence
  derived and/or modified sequence opt3 from VP1__Norovirus_and/or_Norovirus-like__EF547395
augaugauggccagcaaggacgcucccaccuccccugauggcgcaucuggggccggacagcuggugccagaagcgaacacagcugaacaaaucucaauggacccggucgccggugcaaguacugccguugcuacggcaggccaggugaauaugauugaucccuggauauucaacaauuuuguacaggccccucagggggaguucaccaucagcccaaacaauacacccggagacauucucuuugaucuucaacugggcccucacuugaacccauucuuagcucaucugucccagauguacaaugguuggguggggaacaugagagucaggauccuacucgccggaaaugcguuuacugcaggcaaaauuaucauaugcugugugcccccuggcuucgacgcccggauccugaccauugcucaggccacacuuuuuccacaccugaucgcagauguucgcaccuuggaaccgguggagcucccccuggaagacguccgaaacgugcuguuccauaauucuucgcagccucaaccaacuaugcgucucguagcuauguuauauacaccccugagaaccgggggagguucaggcgggacggaugccuuuguuguggcgggaaggguccuuacuugcccugccccagacuucagcuuuuuguuccuggugcccccgaguguggagcagaagacccgggucuuuuccguuccuaacgugccccuaaaagaucucucuaauagccgcguaccagugccuauucagggcauguucaugucccccgacgucaaccagucagugcaauuccagaaugguagaugucagaucgaugggcaacugcagggaacaacuccaguuagucuuagccagcugugcaagauaaggggcaaaaccucuuccaacgcacggguguugaaccucucagaggucgacggcagccccuuuauuccucuggaaaguccagcuccggugggguuccccgacuuaggagguugugauuggcacguaaauuuuacauuccaggcccaagaccaggauccuucucaguccguuaccuuugcuacgaacgacgccagcuucgugccauaccugggcucgaucucuccccauaaugggggagauuuucacuccggcgacauuaucgguucacucggguggaucagugcaccuagcgauuccucucagcuuaacgucuggacuauuccaaaguauggcagcucacugcccgacgugacacacuuggccccggcugucuucccuccaggauuuggcgaggugauacuauacuucuauaguaccuuucccggguccggacaaccuggucagcugcagguucccugccuccugccacaggaguucaucacucauuuuuguaaugaacaagcgccuauugcaggcgaggccgcccuucugcacuacguggaucccgacacagggcgcaacuugggagaguucaagcucuauccagauggcuucaugaccugcguaccgaauagcgucucuucagguccucagacgcugcccaucaacgggguguuuguuuucgugaguugggucagccgauuuuaccaguuaaaaccagugggcaccgcuuccguagcaagaaggcuguga

SEQ ID NO: 21681 - RNA, 1608 nt, Artificial Sequence
  derived and/or modified sequence opt3 from VP1__Norovirus_and/or_Norovirus-like__AY502008
augaugauggccagcaaggacgcucccaccuccccugauggcgcaucuggggccggacagcuggugccagaagcgaacacagcugaacaaaucucaauggacccggucgccggugcaaguacugccguugcuacggcaggccaggugaauaugauugaucccuggauauucaacaauuuuguacaggccccucagggggaguucaccaucagcccaaacaauacacccggagacauucucuuugaucuucaacugggcccucacuugaacccauucuuagcucaucugucccagauguacaaugguuggguggggaacaugagagucaggauccuacucgccggaaaugcguuuacugcaggcaaaauuaucauaugcugugugcccccuggcuucgacgcccggauccugaccauugcucaggccacacuuuuuccacaccugaucgcagauguucgcaccuuggaaccgguggagcucccccuggaagacguccgaaacgugcuguuccauaauucuucgcagccucaaccaacuaugcgucucguagcuauguuauauacaccccugagaaccgggggagguucaggcgggacggaugccuuuguuguggcgggaaggguccuuacuugcccugccccagacuucagcuuuuuguuccuggugcccccgaguguggagcagaagacccgggucuuuuccguuccuaacgugccccuaaaagaucucucuaauagccgcguaccagugccuauucagggcauguucaugucccccgacgucaaccagucagugcaauuccagaaugguagaugucagaucgaugggcaacugcagggaacaacuccaguuagucuuagccagcugugcaagauaaggggcaaaaccucuuccaacgcacggguguugaaccucucagaggucgacggcagccccuuuauuccucuggaaaguccagcuccggugggguuccccgacuuaggagguugugauuggcacguaaauuuuacauuccaggcccaagaccaggauccuucucaguccguuaccuuugcuacgaacgacgccagcuucgugccauaccugggcucgaucucuccccauaaugggggagauuuucacuccggcgacauuaucgguucacucggguggaucagugcaccuagcgauuccucucagcuuaacgucuggacuauuccaaaguauggcagcucacugcccgacgugacacacuuggccccggcugucuucccuccaggauuuggcgaggugauacuauacuucuauaguaccuuucccggguccggacaaccuguucagcuccaggugcccugccugcugccacaggaguucaucacucauuuuuguaaugaacaagcgccuauugcuggugaggccgcacuucugcacuacguagaucccgacacaggccgcaacuugggggaguucaagcucuauccagauggauucaugaccugcgucccgaauagcgugucuucaggcccucagacgcugcccaucaacgguguuuuuguguucgucaguugggugagccgauuuuaccaguuaaaaccaguagggaccgccuccguggcaagaaggcuguga

SEQ ID NO: 21682 - RNA, 1608 nt, Artificial Sequence
  derived and/or modified sequence opt3 from VP1__Norovirus_and/or_Norovirus-like__AY502007
augaugauggccagcaaggacgcucccaccuccccugauggcgcaucuggggccggacagcuggugccagaggcgaacacagcugaacaaaucucaauggacccggucgccggugcaaguacugccguugcuacggcaggccaggugaauaugauugaucccuggauauucaacaauuuuguacaggccccucagggggaguucaccaucagcccaaacaauacacccggagacauucucuuugaucuucaacugggcccucacuugaacccauucuuagcucaucugucccagauguacaaugguuggguggggaacaugagagucaggauccuacucgccggaaaugcguuuacugcaggcaaaauuaucauaugcugugugcccccuggcuucgacgcccggauccugaccauugcucaggccacacuuuuuccacaccugaucgcagauguucgcaccuuggaaccgguggagcucccccuggaagacguccgaaacgugcuguaucauaauucuucgcagccucaaccaacuaugcgucucguagcuauguuauacacaccccugagaaccgggggagguucaggcgggacggaugccuucguuguggcgggaaggguccuuacuugcccugccccagacuuuagcuucuuguuucuggugcccccgaguguggagcagaagacccgggucuucuccguuccuaacauuccccuaaaagaucucucuaauagccgcgugccaguaccuauccagggcauguuuaugucccccgacgugaaccagucaguccaauuccagaaugguagaugucagauagaugggcaacugcagggaacaacuccagugagucuuagccagcugugcaagauuaggggcaaaaccucuuccaacgcacggguuuugaaccucucagagguggacggcacacccuucgucccucuggaaagcccagcuccggugggguuucccgacuuaggagguugugauuggcacguaaauuucaccuuucaggcccaaaaccaggacccuagucagucuguuacguucgcuacuaaugaugccuccuuugugccauaucugggcagcaucucgccccauaacgggggagacuuccacgcaggcgauauuaucgguucucucggguggaucuccgccccuucagacaauacacagcuuaacgucuggaccauuccaaaguacggcaguagccugcccgaugugacucacuuggcuccggcggucuuuccuccaggauucggcgaggugauacuauauuuuuacuccacauuccccgggucuggacaaccuagccagcugcagguucccugccuccugccacaggaauuuaucacccauuucuguaaugagcaagcaccuauugccggugaggcugcccuucugcacuauguggaccccgauacgggccgcaacuugggggaauuuaagcucuacccagacggauucaugaccugcguaccuaauucagucaguuccggcccgcagacacugcccaucaacgguguguucguuuuugugagcugggucucucgauucuaccaguuaaaaccaguggggacugcaucagccgcuagaaggcuguga

SEQ ID NO: 21683 - RNA, 1608 nt, Artificial Sequence
  derived and/or modified sequence opt3 from VP1__Norovirus_and/or_Norovirus-like__KC998959
augaugauggccagcaaggacgcucccaccuccccugauggcgcaucuggggccggacagcuggugccagaggcgaacacagcugaacaaaucucaauggacccggucgccggugcaaguacugccguugcuacggcaggccaggugaauaugauugaucccuggauauucaacaauuuuguacaggccccucagggggaguucaccaucagcccaaacaauacacccggagacauucucuuugaucuucaacugggcccucacuugaacccauucuuagcucaucugucccagauguacaaugguuggguggggaacaugagagucaggauccuacucgccggaaaugcguuuacugcaggcaaaauuaucauaugcugugugcccccuggcuucgacgcccggauccugaccauugcucaggccacacuuuuuccacaccugaucgcagauguucgcaccuuggaaccgguggagcucccccuggaagacguccgaaacgugcuguaucauaauucuucgcagccucaaccaacuaugcgucucguagcuauguuauacacaccccugagaaccgggggagguucaggcgggacggaugccuucguuguggcgggaaggguccuuacuugcccugccccagacuuuagcuucuuguuucuggugcccccgaguguggagcagaagacccgggucuucuccguuccuaacauuccccuaaaagaucucucuaauagccgcgugccaguaccugugcagggcauguuuaugucccccgacgucaaccagucagugcaauuccagaaugguagaugucagaucgaugggcaacugcagggaacaacuccaguuagucuuagccagcugugcaagauaaggggcaaaaccucuuccaacgcacggguguugaaccucucagaggucgacggcacacccuucauuccucuggaaagcccagcuccggugggguuucccgacuuaggagguugugauuggcacguaaauuucaccuuucaggcccaagaccaggauccuagucagucuguuacguucgcuacuaacgacgccuccuuugugccauaucugggcagcaucucgccccauaaugggggagauuuccacgcaggcgacauuaucgguucucucggguggaucuccgccccuucaggcaacagucagcuuaaugucugggcuauuccaaaguacggaagcucccugcccgaugugacacacuuggcgccggcagucuuuccuccaggcuucggggaggugauacuauauuuuuacucuaccuuccccggaagcggucaaccuucacagcugcagguucccugccuccugccacaggaauuuaucacucauuucuguaacgagcaagccccuauugcuggcgaggccgcacuucugcacuauguggaccccgauacagggcgcaauuugggagaauuuaagcucuacccagacggcuucaugaccugcguaccgaacagugucuccagcgguccucagacgcugcccaucaaugggguguucguuuuugugucuugggucucacgauucuaccaguuaaaaccagugggcaccgccagugcugccagaaggcuguga

SEQ ID NO: 21684 - RNA, 1608 nt, Artificial Sequence
  derived and/or modified sequence opt3 from VP1__Norovirus_and/or_Norovirus-like__GQ856464
augaugauggccagcaaggacgcucccaccuccccugauggcgcaucuggggccggacagcuggugccagaggcgaacacagcugaacaaaucucaauggacccggucgccggugcaaguacugccguugcuacggcaggccaggugaauaugauugaucccuggauauucaacaauuuuguacaggccccucagggggaguucaccaucagcccaaacaauacacccggagacauucucuuugaucuucaacugggcccucacuugaacccauucuuagcucaucugucccagauguacaaugguuggguggggaacaugagagucaggauccuacucgccggaaaugcguuuacugcaggcaaaauuaucauaugcugugugcccccuggcuucgacgcccggauccugaccauugcucaggccacacuuuuuccacaccugaucgcagauguucgcaccuuggaaccgguggagcucccccuggaagacguccgaaacgugcuguaucauaauucuucgcagccucaaccaacuaugcgucucguagcuauguuauacacaccccugagaaccgggggagguucaggcgggacggaugccuucguuguggcgggaaggguccuuacuugcccugccccagacuuuagcuucuuguuucuggugcccccgaguguggagcagaagacccgggucuucuccguuccuaacauuccccuaaaagaucucucuaauagccgcgugccaguaccuauccagggcauguuuaugucccccgacgugaaccagucaguccaauuccagaaugguagaugucagauagaugggcaacugcagggaacaacuccagugagucuuagccagcugugcaagauuaggggcaaaaccucuuccaacgcacggguuuugaaccucucagagguggacggcacacccuucaucccucuggaaagcccagcuccggucggguuucccgacuuaggagguugugauuggcacgugaauuucaccuuucagacgcaagaccgcgauccuagucagucuguaacuuucgccacaaacgacgcuuccuuuguuccauaucugggcagcgugucgccccauaauggggagggauuccaggccggcgauauuaucgguucucucggguggaucuccgcaccuucagacaacagucaguuuaaugucugggccauuccaaaguacggcagcucccuucccgaugugacccaccuggcuccggcggucuucccuccaggauuuggcgaagugauauuguauuucuacucuacuuuucccgggagcggacaaccuucacagcuacagguucccugccugcucccacaggaguucaucacacacuuuuguaacgagcaagcaccuauugccggugaagcugcccugcuucauuauguggaccccgauaccggccgaaaucugggggaguucaaguuguacccagacggauucaugacgugcguaccgaacagugucuccagcggcccucagacccuccccaucaaugguguguuuguuuucgugucuugggucucaagauuuuaccagcugaaaccaguggggacagcaagugccgcuaggcgguuauga

SEQ ID NO: 21685 - RNA, 1608 nt, Artificial Sequence
  derived and/or modified sequence opt3 from VP1__Norovirus_and/or_Norovirus-like__GQ856463
augaugauggccagcaaggacgcucccaccuccccugauggcgcaucuggggccggacagcuggugccagaggcgaacacagcugaacaaaucucaauggacccggucgccggugcaaguacugccguugcuacggcaggccaggugaauaugguagaucccuggauuuucaacaauuuugugcaggccccucagggggaguucaccauaagcccaaacaauacacccggagacauccucuuugaucuucaacugggcccucacuugaacccauucuuagcucaucugucccagauguacaaugguugggucgggaacaugagagugaggauucuacucgccggaaaugcguuuacugcaggcaaaaucauuaucugcuguguucccccuggcuucgacgcccggauacugaccaucgcucaggccacacuuuuuccacaccugauugcagaugugcgcaccuuggaaccggucgagcucccccuggaagacgugcgaaacguacuguaucauaauucuucgcagccucaaccaacuaugcgucucguugcuauguuauacacaccccugagaaccgggggagguucaggcgggacggaugccuucguggucgcgggaagggugcuuacuugcccugccccagacuuuagcuucuuguuucuggugcccccgagugucgagcagaagacccggguuuucuccgugccuaacaucccccuaaaagaucucucuaauagccgcguaccagugccuauucagggcauguuuaugucccccgacgucaaccagucagugcaauuccagaaugguagaugucagaucgaugggcaacugcagggaacaacuccaguuagucuuagccagcugugcaagauaaggggcaaaaccucuuccaacgcacggguguugaaccucucagaggucgacggcacacccuucauuccucuggaaagcccagcuccggugggguuucccgacuuaggagguugugauuggcacguaaauuucaccuuucagacgcaagaccgcgauccuagucagucuguuacuuucgccacaaacgacgcuuccuuugugccauaucugggcagcgucucgccccauaauggggagggauuccaggccggcgauaucauugguucucucggguggaucuccgcaccuucagacaacagucaguuuaaugugugggccaucccaaaguacggcagcucccuucccgaugucacccaccuggcuccggcgguguucccuccaggauuuggcgaaguuauuuuguauuucuacucuacuuuucccgggagcggacaaccuucacagcuacaggugcccugccugcucccacaggaguucauaacacacuuuuguaacgagcaagcaccuaucgccggugaagcugcccugcuucauuauguagaccccgauaccggccgaaaucugggggaguucaaguuguacccagacggauucaugacgugcgucccgaacaguguguccagcggcccucagacccuccccauuaaugguguuuuuguguucgucucuugggugucaagauuuuaccagcugaaaccaguagggacagcaagugccgcuaggcgguuauga

SEQ ID NO: 21686 - RNA, 1608 nt, Artificial Sequence
  derived and/or modified sequence opt3 from VP1__Norovirus_and/or_Norovirus-like__KM036372
augaugauggccagcaaggacgcucccaccuccccugauggcgcaucuggggccggacagcuggugccagaggcgaacacagcugaacaaaucucaauggacccggucgccggugcaaguacugccguugcuacggcaggccaggugaauaugauugaucccuggauauucaacaauuuuguacaggccccucagggggaguucaccaucagcccaaacaauacacccggagacauucucuuugaucuucaacugggcccucacuugaacccauucuuagcucaucugucccagauguacaaugguuggguggggaacaugagagucaggauccuacucgccggaaaugcguuuacugcaggcaaaauuaucauaugcugugugcccccuggcuucgacgcccggauccugaccauugcucaggccacacuuuuuccacaccugaucgcagauguucgcaccuuggaaccgguggagcucccccuggaagacguccgaaacgugcuguaucauaauucuucgcagccucaaccaacuaugcgucucguagcuauguuauacacaccccugagaaccgggggagguucaggcgggacggaugccuucguuguggcgggaaggguccuuacuugcccugccccagacuuuagcuucuuguuucuggugcccccgaguguggagcagaagacccgggucuucuccguuccuaacauuccccuaaaagaucucucuaauagccgcgugccaguaccugugcagggcauguuugucucccccgacgugaaccagucaguucaauuccagaaugguagaugucagaucgaugggcaacugcagggaacaacuccagugagucuuagccagcugugcaagauaaggggcaaaaccucuuccaacgcacgggucuugaaccucucagagguggacggcacacccuucauuccucuggaaagcccagcuccgguaggguuucccgacuuaggagguugugauuggcacguuaauuucaccuuucagacgcaagaccgcgauccuagucagucugugacuuucgccacaaacgacgcuuccuuugucccauaucugggcagcgugucgccccauaauggggagggauuccaggccggcgauaucauugguucucucggguggaucuccgcaccuucagacaacagucaguuuaaugucugggccaucccaaaguacggcagcucccuucccgaugugacccaccuggcuccggcgguuuucccuccaggauuuggcgaagugauuuuguauuucuacucuacuuuucccgggagcggacaaccuucacagcuacagguacccugccugcucccacaggaguucauaacacacuuuuguaacgagcaagcaccuaucgccggugaagcugcccugcuucauuaugucgaccccgauaccggccgaaaucugggggaguucaaguuguacccagacggauucaugacgugcgugccgaacaguguuuccagcggcccucagacccuccccauuaaugguguguuugucuucgugucuuggguaucaagauuuuaccagcugaaaccaguggggacagcaagugccgcuaggcgguuauga

SEQ ID NO: 21687 - RNA, 1608 nt, Artificial Sequence
  derived and/or modified sequence opt3 from VP1__Norovirus_and/or_Norovirus-like__AF538678
augaagauggccagcaaagacgcucccccuuccccagauggcgcaucuggggccggacagcuggugccggaggucaacaccgcggaccaaaucucaauggaucccguugcuggugccaguacagcaguggccacugcuggccagguaaauaugauugacccuuggauauucaacaauuuugugcaggcaccacagggggaguucacgaucagccccaacaauaccccuggagauauucucuuugaccuucaacugggcccacacuugaaccccuucuuagcccaucugucccagauguacaaugguugggucgggaacaugagagugaggauccuacucgcuggaaaugccuuuacagcgggcaagauuaucauaugcuguguuccuccaggcuucgaugcacggauccugacuauugcccaggcuacccuuuuuccgcaccugaucgccgacgugcgcacauuggaacccgucgaacucccucuggaggaugugcgaaacguacuguaucauaauucuucgcagccacaacccaccaugcgucucguugcaauguuauacacuccucugagaacagggggagguucaggcgggaccgacgcuuucguggucgccggaagggugcuuacgugcccagcgcccgauuuuagcuucuuguuucuggugccgccuagugucgaacagaaaacucggguuuucuccgugcccaacauuccacuaaaggaccucucuaauagccgcguaccuacccugauccagggcauguuugugucccccgaugucaaccagucagugcaauuccagaaugguagaugucagauagacgggcaacuucagggaacaacuccaguuagucugagccaguugugcaaaauuaggggcaagaccucuuccaacacacgggugcucaaccugucagaggucgacggcacccccuucgugccuuuagagagcccagccccgguaggguuucccgauaucggagguugugacuggcacguuggcuucacguuugaagcacgcgaucaggacccuagucaaaaugugacuuucgcuacaaacgauucuuccuuugucccauaucuggggagcauuucgccccauaauggagacggcuuccacucuggugauaucguggggucccucgacuggaucucagccccuagugauggcagcgcucuugacgucugguccauuccaaaguacggaucuagccugcccgaugugacccacuuggccccgguuguguuuccuccaggcuucggggagguaauacuauauuuucauucaaaauuccccggaagugguccuacugacaagcugcgaguccccugccucaugccacaggaauuuaucacacacuucuguaacgagcaggcaccuauugccggcgaggcugcgcugcuucauuacguggaccccgauaccgggagaaaucugggagaauuuaaauuguauuccgacggcuucaugacgugcguuccaaacagcaucucuucagguccgcagacccucccuauaaaugggguguucgucuuugugaguuggguaagcagguucuaccaacugaagcccgugggcacagcauccgccgcucggcguuuauga

SEQ ID NO: 21688 - RNA, 1608 nt, Artificial Sequence
  derived and/or modified sequence opt3 from VP1__Norovirus_and/or_Norovirus-like__KC294198
augaugauggccagcaaggacgcucccaccuccccugauggcgcaucuggggccggacagcuggugccagaagcgaacacagcugaacaaaucucaauggacccggucgccggugcaaguacugccguugcuacggcaggccaggugaauaugauugaucccuggauauucaacaauuuuguacaggccccucagggggaguucaccaucagcccaaacaauacacccggagacauucucuuugaucuucaacugggcccucacuugaacccauucuuagcucaucugucccagauguacaaugguuggguggggaacaugagagucaggauccuacucgccggaaaugcguuuacugcaggcaaaauuaucauaugcugugugcccccuggcuucgacgcccggauccugaccauugcucaggccacacuuuuuccacaccugaucgcagauguucgcaccuuggaaccgguggagcucccccuggaagacguccgaaacgugcuguuccauaauucuucgcagccucaaccaacuaugcgucucguagcuauguuauauacaccccugagaaccgggggagguucaggcgggacggaugccuuuguuguggcgggaaggguccuuacuugcccugccccagacuucagcuuuuuguuccuggugcccccgaguguggagcagaagacccgggucuuuuccguuccuaacauuccccuaaaagaucucucuaauagccgcgugccaguaccugugcagggcauguucaugucccccgacgucaaccagucagugcaauuccagaaugguagaugucagaucgaugggcaacugcagggaacaacuccaguuagucuuagccagcugugcaagauaaggggcaaaaccucuuccaacgcacggguguugaaccucucagaggucgacggcacacccuuuauuccucuggaaagcccagcuccggugggguuccccgacuuaggagguugugauuggcacguaaauuuuaccuuccaggcccaaaaccaggacccuagucagucuguuacguuugcuacuaaugaugccuccuucgugccauaccugggcagcaucucgccccauaacgggggagacuuucacgcaggcgauauuaucgguucucucggguggaucuccgccccuucagacaauagucagcuuaacgucuggacaauuccaaaguauggcagcucccugcccgaugugacccacuuggcuccggcggucuucccuccaggauuuggcgaggugauacuauacuucuauucuacuuuucccgggagcggacaaucaagucagcugcagguuccuugccuccugccccaggaguucaucacacauuuuuguaaugaacaagcaccaauugccggugaggcugcccuucugcacuacguggacccugauaccggccgcaacuugggggaguucaagcucuaucccgacggauucaugacgugcguaccaaauuccgucagcucuggcccgcagacccugccuaucaacgguguguuuguuuucgugucaugggucagucgauuuuaccaguuaaaacccguggggacagcaagcgccgcuagaaggcuguga

SEQ ID NO: 21689 - RNA, 1608 nt, Artificial Sequence
  derived and/or modified sequence opt3 from VP1__Norovirus_and/or_Norovirus-like__KT732280
augaugauggccagcaaggacgcucccaccuccccugauggcgcaucuggggccggacagcuggugccagaggucaacacagcggaccaaaucucaauggauccgguugcuggugccaguacugcaguggccacggcuggccagguaaauaugauugaccccuggauauucaacaauuuugugcaggcaccucagggggaauuuaccaucagcccaaacaauacacccggagauauucucuuugaccuucaacugggcccucacuugaacccauucuuagcccaucugucccagauguacaaugguugggucgggaacaugagagugaggauccuacucgcuggaaaugccuuuacugcgggcaaaauuaucauaugcuguguucccccuggcuucgaugcacggauccugaccauugcccaggcuacacuuuuuccacacaugaucgccgacgugcgcacccuggagccggucgaauugccccucgaggaugugcgaaacguacuguaucauaauucuucgcagccucaaccaacuaugcgucugguugcaaugcucuacacacccuuaagaaccgggggagguucaggcgggacggacgcuuucguggucgccggaagggugcugacuugcccugcgccagauuuuagcuuccuuuucuuggugcccccgagugucgaacagaagacccggguuuucuccgugccuaacauuccccugaaagaccuaucuaauagccgcguaccaacacucauccagggcauguuuguguccccugaugucaaccagucagugcaauuccagaaugguagaugucagauagacgggcaacugcagggaacuacccccguuagucuuagccagcugugcaagauuaggggcaaaacaucuuccaacgcccggguguugaaccucucagaggucgacggcaccccauucgugccccuggagagcccugcaccaguaggguuuccggauuuaggagguugugacuggcacguuggcuucacguuugaagcucgcgaucaggaccccagucaaaaugugacuuucgccacaaacgauucuuccuuugucccuuaucuggggagcaucucgccacauaauggagacggcuuccacucuggugauauuaucgggucccucgacuggaucucagcucccagugauggcagcacccuugacgugugguccauuccuaaguacggaucuagccugccagaugucacucacuuggcccccgcaguguuuccgccuggcuucggggagguuauacuauauuuucauucaaaguucccaggaaguggucccacagacaaacugcgagugccuugccucaucccccaggaauuuauuacccacuucuguaacgagcaggccccaaucgcuggcgaggcggcacugcuucauuacguagacccugauacggggagaaaucugggagaauuuaaguuguaucccgacggcuucaugaccugcgucccaaacuccauaagcucugguccgcagacacucccuacuaaugggguguucguuuuugugucaugggucaguagguucuaccaacugaaacccgugggcaccgccagcauggcucggcguuuauga

SEQ ID NO: 21690 - RNA, 1608 nt, Artificial Sequence
  derived and/or modified sequence opt3 from VP1__Norovirus_and/or_Norovirus-like__LC101822
augaugauggccagcaaggacgugcccaccuccccugauggcgcuucuggggcaggacagcuggucccagagguuaacacagccgaccaaaucucaauggauccgguggcgggugcuaguacugccguagcaacggccggccaggugaauaugauugaccccuggauauucaacaauuuuguccaggcuccucagggggaguucaccaucagcccaaacaauacacccggagauauucucuuugaccuucaacugggcccucacuugaacccauucuuagcacaucugucccagauguacaaugguuggguggggaacaugagaguuaggauccuacucgccggaaaugcuuuuacugccggcaaaauuaucauaugcugugugcccccuggcuucgaugcgcggauccugaccauugcacaggccacacuuuuuccacaccugaucgcugacguccgcaccuuggaaccgguggaacucccccuggaggauguacgaaacguucuguaucauaauucuucgcagccucaaccaacuaugcgucucguggccauguuauacacaccccugagaaccgggggagguucaggcgggacggacgcauucgucguggcuggaagggugcuuacuugcccugccccagauuuuagcuucuuguuucugguucccccgagugucgaacagaagacccggguguucuccguaccuaacauuccccuaaaagaccucucuaauagccgcgugccaacacugauccagggcauguuugucuccccugaugugaaccagucaguucaauuccagaaugguagaugucagauagacgggcaacuucagggaacuacccccgugagucugagccaguugugcaagauuaggggcaaaacaucuuccaacacccggguccucaaccugucagagguggacggcacgccauucguacccuuagagagcccugcgccaguuggguuuccggauaucggagguugugacuggcacgugggcuucacuuuugaagcccgcgaucaggggcccagucaaaaugucacauucgcaaccaacgacucuuccuuugugccuuaucugggaagcauuucgccacauaauggcgaugguuuccacucuggggacaucaucggcucccucgauuggauuucagcucccagugacggaagcgcccuugaugucugguccauaccuaaguacggcucuagccugccagacgugacucacuuggcucccgccguuuuuccgccuggguucggagaggugauccuauauuuucauucaaaguucccagguaguggccccacagauaaacugcgaguaccuugccucaugccccaggaauuuauuacccacuucugugacgagcaggcaccaaucgccggggaggcugcgcugcuucauuacgucgacccugaugcaggaagaaaccugggcgaauuuaaguuguaucccgacgguuucaugacgugcgugccaaauuccauaagcucugggccgcagacccucccuauuaacggcguuuucguguuugucucaugggugaguagguucuaccaacugaaacccguaggaacagccagcauggcucggcguuuauga

SEQ ID NO: 21691 - RNA, 1608 nt, Artificial Sequence
  derived and/or modified sequence opt3 from VP1__Norovirus_and/or_Norovirus-like__KP407451
augaugauggccagcaaggacgcucccaccuccccugauggcgcaucuggggccggacagcuggugccagaggcgaacacagcugaacaaaucucaauggacccggucgccggugcaaguacugccguugcuacggcaggccaggugaauaugauugaucccuggauauucaacaauuuuguacaggccccucagggggaguucaccaucagcccaaacaauacacccggagacauucucuuugaucuucaacugggcccucacuugaacccauucuuagcucaucugucccagauguacaaugguuggguggggaacaugagagucaggauccuacucgccggaaaugcguuuacugcaggcaaaauuaucauaugcugugugcccccuggcuucgacgcccggauccugaccauugcucaggccacacuuuuuccacaccugaucgcagauguucgcaccuuggaaccgguggagcucccccuggaagacguccgaaacgugcuguaucauaauucuucgcagccucaaccaacuaugcgucucguagcuauguuauacacaccccugagaaccgggggagguucaggcgggacggaugccuucguuguggcgggaaggguccuuacuugcccugccccagacuuuagcuucuuguuucuggugcccccgaguguggagcagaagacccgggucuucuccguuccuaacauuccccuaaaagaucucucuaauagccgcgugccaguaccuauccagggcauguuuaugucccccgacgugaaccagucaguccaauuccagaaugguagaugucagauagaugggcaacugcagggaacaacuccagugagucuuagccagcugugcaagauuaggggcaaaaccucuuccaacgcacggguuuugaaccucucagagguggacggcacacccuucaucccucuggaaagcccagcuccggucggguuucccgacuuaggagguugugauuggcacgugaauuucaguuuucagacccaagaccgcgauccuucucaguccguaacguucgccacuaacgacgcuagcuuuguuccauaucugggcucggugucuccccauaauggggagggauuccaggccggcgauauuaucgguucccucggguggaucucagcaccuagugacaacagccaguuuaaugucugggccauuccaaaguacggcuccucucuucccgaugugacacaccuggcuccggcggucuucccuccaggauuuggcgaagugauauuguauuucuacagcaccuuucccgggucaggacaaccuagucagcuacagguucccugccugcucccacaggaguucaucacucacuuuuguaacgagcaagcaccuauugccggugaagcugcccugcuucauuauguggaccccgauacaggccgaaaucugggggaguucaaguuguacccagacggauucaugaccugcguaccgaacuccgucagcucuggcccucagacgcuccccaucaaugguguguuuguuuucgugucaugggucaguagauuuuaccagcugaaaccaguggggaccgcaagcgccgcuaggcgguuauga

SEQ ID NO: 21692 - RNA, 1608 nt, Artificial Sequence
  derived and/or modified sequence opt3 from VP1__Norovirus_and/or_Norovirus-like__LN854564
augaugauggccagcaaggacgcucccaccuccccugauggcgcaucuggggccggacagcuggugccagaggcgaacacagcugaacaaaucucaauggacccggucgccggugcaaguacugccguugcuacggcaggccaggugaauaugauugaucccuggauauucaacaauuuuguacaggccccucagggggaguucaccaucagcccaaacaauacacccggagacauucucuuugaucuucaacugggcccucacuugaacccauucuuagcucaucugucccagauguacaaugguuggguggggaacaugagagucaggauccuacucgccggaaaugcguuuacugcaggcaaaauuaucauaugcugugugcccccuggcuucgacgcccggauccugaccauugcucaggccacacuuuuuccacaccugaucgcagauguucgcaccuuggaaccgguggagcucccccuggaagacguccgaaacgugcuguaucauaauucuucgcagccucaaccaacuaugcgucucguagcuauguuauacacaccccugagaaccgggggagguucaggcgggacggaugccuucguuguggcgggaaggguccuuacuugcccugccccagacuuuagcuucuuguuucuggugcccccgaguguggagcagaagacccgggucuucuccguuccuaacauuccccuaaaagaucucucuaauagccgcgugccaguaccuauccagggcauguuuaugucccccgacgugaaccagucaguccaauuccagaaugguagaugucagauagaugggcaacugcagggaacaacuccagugagucuuagccagcugugcaagauuaggggcaaaaccucuuccaacgcacggguuuugaaccucucagagguggacggcacacccuucaucccucuggaaagcccagcuccggucggguuucccgacuuaggagguugugauuggcacgugaauuucaccuuucaggcccaaaaccaggacccuagucagucuguaacguucgcuacuaaugaugccuccuuuguuccauaucugggcagcauuucgccccauaacgggggagacuuccacgcaggcgauaucaucgguucucucggguggauuuccgccccuucagacaauagucagcuuaacguguggacaauaccaaaguacggcagcucccugcccgaugucacccacuuggcuccggcgguguuuccuccaggauucggcgaggucauccuauauuuuuacucuacuuuccccgggagcggacaaccuucacagcuccaggugcccugccugcugccacaggaauuuauuacacauuucuguaaugagcaagcaccuaucgccggugaggcugcccuucugcacuauguugaccccgauaccggccgcaacuugggggaauuuaagcucuacccagacggauucaugacgugcgugccgaauaguguauccagcggcccucagacccugcccauaaacggugucuucguguuuguuucuugggugucacgauucuaccaguuaaaaccagucgggacagcaagugccgcuagaaggcuguga

SEQ ID NO: 21693 - RNA, 1608 nt, Artificial Sequence
  derived and/or modified sequence opt3 from VP1__Norovirus_and/or_Norovirus-like__JQ388274
augaugauggccagcaaggacgcucccaccuccccugauggcgcaucuggggccggacagcuggugccagaggcgaacacagcugaacaaaucucaauggacccggucgccggugcaaguacugccguugcuacggcaggccaggugaauaugauugaucccuggauauucaacaauuuuguacaggccccucagggggaguucaccaucagcccaaacaauacacccggagacauucucuuugaucuucaacugggcccucacuugaacccauucuuagcucaucugucccagauguacaaugguuggguggggaacaugagagucaggauccuacucgccggaaaugcguuuacugcaggcaaaauuaucauaugcugugugcccccuggcuucgacgcccggauccugaccauugcucaggccacacuuuuuccacaccugaucgcagauguucgcaccuuggaaccgguggagcucccccuggaagacguccgaaacgugcuguaucauaauucuucgcagccucaaccaacuaugcgucucguagcuauguuauacacaccccugagaaccgggggagguucaggcgggacggaugccuucguuguggcgggaaggguccuuacuugcccugccccagacuuuagcuucuuguuucuggugcccccgaguguggagcagaagacccgggucuucuccguuccuaacauuccccuaaaagaucucucuaauagccgcgugccaguaccugugcagggcauguuuaugucccccgacgucaaccagucagugcaauuccagaaugguagaugucagaucgaugggcaacugcagggaacaacuccaguuagucuuagccagcugugcaagauaaggggcaaaaccucuuccaacgcacggguguugaaccucucagaggucgacggcacacccuucauuccucuggaaagcccagcuccggugggguuucccgacuuaggagguugugauuggcacguaaauuucaccuuucaggcccaaaaccaggacccuagucagucuguuacguucgcuacuaaugaugccuccuuugugccauaucugggcagcaucucgccccauaacgggggagacuuccacgcaggcgauauuaucgguucucucggguggaucuccgccccuucagacaauagucagcuuaacgucuggacaauuccaaaguacggcagcucccugcccgaugugacccacuuggcuccggcggucuuuccuccaggauucggcgaggugauacuauauuuuuacucuacuuuccccgggagcggacaaccuucacagcugcagguucccugccuccugccacaggaauuuaucacacauuucuguaaugagcaagcaccuauugccggugaggcugcccuucugcacuauguggaccccgauaccggccgcaacuugggggaauuuaagcucuacccagacggauucaugacgugcguaccgaauagugucuccagcggcccucagacccugcccaucaacgguguguucguuuuugugucuugggucucacgauucuaccaguuaaaaccaguggggacagcaagugccgcuagaaggcuguga

SEQ ID NO: 21694 - RNA, 1608 nt, Artificial Sequence
  derived and/or modified sequence opt3 from VP1__Norovirus_and/or_Norovirus-like__KP027330
augaugauggccagcaaggacgcucccaccuccccugauggcgcaucuggggccggacagcuggugccagaggucaacacagcggaccaaaucucaauggauccgguugcuggugccaguacugcaguggccacggcuggccagguaaauaugauugaccccuggauauucaacaauuuugugcaggcaccucagggggaauuuaccaucagcccaaacaauacacccggagauauucucuuugaccuucaacugggcccucacuugaacccauucuuagcccaucugucccagauguacaaugguugggucgggaacaugagagugaggauccuacucgcuggaaaugccuuuacugcgggcaaaauuaucauaugcuguguucccccuggcuucgaugcacggauccugaccauugcccaggcuacacuuuuuccacacaugaucgccgacgugcgcacccuggagccggucgaauugccccucgaggaugugcgaaacguacuguaucauaauucuucgcagccucaaccaacuaugcgucugguugcaaugcucuacacacccuuaagaaccgggggagguucaggcgggacggacgcuuucguggucgccggaagggugcugacuugcccugcgccagauuuuagcuuccuuuucuuggugcccccgagugucgaacagaagacccggguuuucuccgugccuaacauuccccugaaagaccuaucuaauagccgcguaccaacacucauccagggcauguuuguguccccugaugucaaccagucagugcaauuccagaaugguagaugucagauagacgggcaacugcagggaacuacccccguuagucuuagccagcugugcaagauuaggggcaaaacaucuuccaacgcccggguguugaaccucucagaggucgacggcaccccauucgugccccuggagagcccugcaccaguaggguuuccggauuuaggagguugugacuggcacguuggcuucacguuugaagcucgcgaucaggaccccagucaaaaugugacuuucgccacaaacgauucuuccuuugucccuuaucuggggagcaucucgccacauaauggagacggcuuccacucuggugauauuaucgggucccucgacuggaucucagcucccagugauggcagcacccuugacgugugguccauuccuaaguacggaucuagccugccagaugucacucacuuggcccccgcaguguuuccgccuggcuucggggagguuauacuauauuuucauucaaaguucccaggaaguggucccacagacaaacugcgagugccuugccucaucccccaggaauuuauuacccacuucuguaacgagcaggccccaaucgcuggcgaggcggcacugcuucauuacguagacccugauacggggagaaaucugggagaauuuaaguuguaucccgacggcuacaugaccugcgucccaaacuccauaagcucugguccgcagacacucccuacuaaugggguguucguuuucgugucaugggucaguagguuuuaccaacugaaacccgugggcaccgccagcauggcucggcguuuauga

SEQ ID NO: 21695 - RNA, 1608 nt, Artificial Sequence
  derived and/or modified sequence opt3 from VP1__Norovirus_and/or_Norovirus-like__AF093797
augaugauggccagcaaggacgcucccccuuccccagauggcgcaucuggggccggacagcuggugccggaggucaacaccgcggaccaaaucucaauggaucccguugcuggugccaguacagcaguggccacugcuggccagguaaauaugauugacccuuggauauucaacaauuuugugcaggcaccacagggggaguucacgaucagccccaacaauaccccuggagauauucucuuugaccuucaacugggcccacacuugaaccccuucuuagcccaucugucccagauguacaaugguugggucgggaacaugagagugaggauccuacucgcuggaaaugccuuuacagcgggcaaaguuauuaucugcugugugccuccaggcuucgaugcacggauacugacuaucgcccaggcuacccuuuuuccgcaccugauugccgacguccgcacauuggaacccguggaacucccucuggaggauguacgaaacguucuguaucauaauucuucgcagccacaacccaccaugcgucucguggcaauguuauacacuccucugagaacagggggagguucaggcgggaccgacgcuuucgucguggccggaagggugcuuacgugcccagcgcccgauuuuagcuucuuguuucuggucccgccuaguguugaacagaagacucggguguucuccguacccaacaucccacuaaaagaccucucuaauagccgcgugccuacccugauucagggcauguuugucucccccgaugugaaccagucaguucaauuccagaaugguagaugucagaucgacgggcaacuucagggaacaacuccagugagucugagccaguugugcaagauaaggggccggaccucuuccaacacacgcguccucaaccugucagagguggacggcacccccuucguaccuuuagagagcccagccccgguuggguuucccgauauuggagguugugacuggcacgugggcuucacguuugaagcacgagaucaggacccuagucaaaaugucacuuucgcuacaaacgauucuuccuuugugccauaucuggggagcaucucgccccauaauggagacggcuuccacucuggugauauuaucgggucccucgacuggaucucagccccuagugauggcagcgcucuugacgucugguccauuccaaaauacggaucuagccugcccgaugugacccacuuggccccggcaguuuuuccuccaggcuucggggaggugauacuauauuuucauucaaaguuccccggaagugguccuacugacaagcugagaguacccugccucaucccacaggaauuuauuacacacuucuguaacgagcaggccccuaucgcuggcgaggcggcacugcuucauuacgucgaccccgauaccgggaggaaucugggagaauuuaaauuguauccagacggcuucaugacgugcgugccgaacuccauaagcucugguccucagacccuccccauuaaugggguuuucguguuugucucaugggugagucgguucuaccaacugaagccaguaggcacagccagcgcugcccgucgcuuauga

SEQ ID NO: 21696 - RNA, 1608 nt, Artificial Sequence
  derived and/or modified sequence opt3 from VP1__Norovirus_and/or_Norovirus-like__AB810006
augaagauggccagcaacgacgcugcacccuccaaugauggcgccgcgucucuggugccugaggcuaucaacgaaaccaugccacucgagccggucgccggggcaucaauugccgcucccguugcaggacagacaaauauaaucgacccuuggauuagaacuaacuucgugcaagccccaaauggugaauuuacgguaagucccaggaacagcccuggcgagauccuucugaauuuggaauuagggccagaucugaaccccuaccuagcucaccucucccggauguauaauggauacgccggcgguguggagguccaggugcugcuugcggggaacgcauucaccgccggaaaaauucuguuugcugccaucccuccaaauuucccgguugacaugauaucucccgcacagaucacaauguugccucaucucauuguggauguccgcacucuggagccaaucaugauuccccugccugacgugcgaaacguauuuuaucacuucaauaaccagccacaaccccguaugagacucguugcuauguuauacaccccgcugaggucgaauggcucaggcgaugacguguuuacagucagcugccgggugcuuacccgcccuacucccgauuucgaauuuaucuauuuggugccaccuagugucgaguccaagacaaaacccuucacccugccaauacuaacgauuucugaacucacuaacagcagauuucccaucccuauugagcagcuguacaccgccccaaacgagaauaacguugugcagugucagaaugggaggugcacacuugacggagaacugcaagguacuacccaguugcucuccucagcgguauguaguuaucggggccgcacaguggccaaccgaggggauaauugggaccagaaccuguuacagcugaccuacccgagcggagcaucuuacgaucccacggacgaggucccugcuccacucggcacucaagacuucuccgguauccuuuauggggugcugacacaggauaauguuucagaaggaaccggcgaggccaagaacgcuaaaggcguguacaucagcacuacaagugggaaguuuacccccaagauuggaucuauagguuugcauuccaucacggaaaauguccacccuaaccagcaaagcagauucaccccagugggcguagcccagaaugagaacacacccuuccagcaguggguucuaccgcauuaugcaggggcccuggcucucaauacuaaccuggcgccugcaguggccccaaccuuucccggagagcaacuucuguucuuuaggucgcgggucccuugcgugcagggcuugcguggucaggacgcuuucauugauugucuccugccccaggaaugggucaaucacuuuuaccaagaggccgcaccaucucaggccgacguggcuuuaauccgcuauguuaacccugauacagggagaacucuguucgaagccaaacuacacagguccggcuuuauaaccgugucacauacaggagcauacccccucguagucccaccgaacggcccuuuccgguuugacaguugggugaaucaguucuauagccuggcgcccauggggaccggauga

SEQ ID NO: 21697 - RNA, 1605 nt, Artificial Sequence
  derived and/or modified sequence opt3 from VP1__Norovirus_and/or_Norovirus-like__LC101825
augaugauggccagcaaggacgcuacccccuccgcagauggcgccaacggggcgggacagcuggugccugaggucaauaacgcugaaccacucccgcuugaccccguugccggugcaucuacagcccuggcuacugcaggccaagugaauaugaucgauccuuggauuuucaacaauuuuguacaggccccacagggggaguucacgauaucacccaacaauaccccuggagacaucuuguuugauuuacagcugggcccacaccuaaaccccuuccucgcucaucugagucaaauguacaaugguuggguggggaacaugagagucagggugauucuugccggaaaugcguuuacagcaggcaaaguuaucauuugcugugugccuccaggcuuccagagccggacucuguccaucgcccaggcuaccuuguuuccgcacgucauagccgacgugcgcacacucgaaccccuggagaucccucuggaagauguacgaaacacccucuaucauaauaacgacucucagccaacuaugcguuuacugugcaugcuuuacacacccuugagaaccgggggagguucgggcgggacggaugcauucguuguggcuggaaggguccugacuuguccuucaccagacuuuaauuuccuauuucucgugcccccgaccguggagcaaaagacacggccuuucagcguccccaacauuccacugcagaaccuuaguaauucccgcguuccuucucugauccagagcaugguguuguccucagaucacgcccagacuguacaauuucagaacggcagaugcaccacagacggucaucuccuggggaccacgcccgugaguagcggacaguuaaugaaauucaggggcaaggucacuccaggcucuaaagugcugaaucucacagagcuugaugggucccccuuccuggcguuugaaccuccagccccggcaggauuccccgacuuggguaagugugacuggcacauugagaugucacuauaucaaguuaacaaucaggauaacccuaucgugcugcgggcuauagaaccaaauagcaguucuuuugucccccaccucggcuccgugagcuucaaccagaauguagacgccgcuggggauuacguuugcaccauucaguauacuucgccuccaucuaacucccaugacgccgauguggacuuuuggucaauccccgauuacggaaguaaucuggcagaggccagccaacuugcuccggucguguauccuccaggcuucggugaggcgauugucuacuuuaugucccgcgugcccggguggaaccgaacaaauagacugaacuugguuccuugucuccugccccaggaguucaucggccacuuugugucugaacaggcaccagccaucggagaagcugccuuacugcauuacguagacccugauaccaauaggaaccuaggcgaguucaagcucuaucccgaaggguuuauuacgugcgucccaaacggaaccgguccgcagcaacugccucuuaauggcguguucguuuuuagcucaugggugagucgguucuaccaguugaaacccgucgggacagcauccagcgcccguuga

SEQ ID NO: 21698 - RNA, 1605 nt, Artificial Sequence
  derived and/or modified sequence opt3 from VP1__Norovirus_and/or_Norovirus-like__AB081723
augaugauggccagcaaggacgcucccaccuccccugauggcgcaucuggggccggacagcuggugccagaggcgaacacagcugaacaaaucucaauggacccggucgccggugcaaguacugccguugcuacggcaggccaggugaauaugauugaucccuggauauucaacaauuuuguacaggccccucagggggaguucaccaucagcccaaacaauacacccggagacauucucuuugaucuucaacugggcccucacuugaacccauucuuagcucaucugucccagauguacaaugguuggguggggaacaugagagucaggauccuacucgccggaaaugcguuuacugcaggcaaaauuaucauaugcugugugcccccuggcuucgacgcccggauccugaccauugcucaggccacacuuuuuccacaccugaucgcagauguucgcaccuuggaaccgguggagcucccccuggaagacguccgaaacgugcuguaucauaauucuucgcagccucaaccaacuaugcgucucguagcuauguuauacacaccccugagaaccgggggagguucaggcgggacggaugccuucguuguggcgggaaggguccuuacuugcccugccccagacuuuagcuucuuguuucuggugcccccgaguguggagcagaagacccgggucuucuccguuccuaacauuccccuaaaagaucucucuaauagccgcgugccaguaccuauccagggcauguuuaugucccccgacgugaaccagucaguccaauuccagaaugguagaugucagauagaugggcaacugcagggaacaacuccagugagucuuagccagcugugcaagauuaggggcaaaaccucuuccaacgcacggguuuugaaccucucagagguggacggcacacccuucaucccucuggaaagcccagcuccggucggguuucccgacuuaggagguugugauuggcacgugaauuucaccuuucaggcccaaaaccaggacccuagucagucuguaacguucgcuacuaaugaugccuccuuuguuccauaucugggcagcauuucgccccauaacgggggagacuuccacgcaggcgauaucaucgguucucucggguggauuuccgccccuucagacaauacacagcuuaacguguggaccauaccaaaguacggcaguagccugcaaauguccuugacucuacaucugcucugcucuccccgccugugggaggucauccuuuauuuuuacagcacauucccgggaucaggccagccuagucagcugcaagugccauguuugcucccccaggaauuuauuacccacuucugcaaugagcaggcuccuaucgcgggggaggcagcccuguuacacuaugucgaucccgacacgggacgaaaccugggugaauuuaagcuauacccagauggcuucaugaccugugugccuaauuccguuagcucugggccccagacacucccaauaaacggaguguuuguauucgucucaugggugaguagauucuaccagcugaaaccgguuggcacugcuagcgccgcaaggcggcuuuga

SEQ ID NO: 21699 - RNA, 1605 nt, Artificial Sequence
  derived and/or modified sequence opt3 from VP1__Norovirus_and/or_Norovirus-like__JN005886
augaugauggccagcaaggacgcucccuccaacauggauggcaccucuggggcaggacagcuggugccugaggucaaugccgcggaaccacucccgcuugagcccguugugggugcugccacagcagccgcuacugcaggccaaguaaaccugaucgacccuuggauuaugaauaacuucgugcaggccccagaaggggaguuuacgauaucacccaauaacaccccuggagauaucuuguucgacuuacaccugggcccacaucuaaaucccuuucuccagcaccugagucagauguacaacgguugggucgggaauaugagagugaggguuaugcuugcuggaaacgccuucacagcgggcaaaauuaucauuugcugugugccuccaggcuuugcaagccaaaauaucuccauagggcaggccacuauguucccgcaugucaucgcugaugugcggguacuggaacccauugagaucccuuuggacgauguucgcaacgugcucuuucacaccaaugagaaccgaccaacaaugcgucugcugugcaugcucuauacccccuuaagagccggaggugcaucuucgggcacugacccuuucgucauugcugggagggugcugacauguccaucacccgauuuuaauuuccuuuucuuggugccgccuagcgucgaacagaagacccggcagcugacgguucccaacaucccacuaaacaaucucgccaacagucgcgugccugcgaugauaaauaaaaugacuguauccaccgaccaaaaccaggugguccaguuccagaauggaagaugcacacuggagggccaacuucuggguacuacccccgugucugccagccagguugcaaggauucgggggaagguguuuuccacagcuucaggaaaaggcuugaaccucaccgaacuggauggcacgccauaccaugccuucgagagucccgcuccuuuaggguucccagacaucggagccugugauuggcacgucagcacuuuuaagguggaccagaaucugucuggugacccgaugucccgccucgauguaaagcaaaacgcacccuucgccccucaccuuggcucaauugaguuuacaagcgaccaggauccaaccggggaccagcugggaacuuuggcuuggguuagucccucuacauccggcgcgcgaguggauccuuggaaaaucccaagcuaugguucgaccgucacggaaucuacccaucuagcacccccgaucuucccuccaggguuuggcgaggccauuguguacuucauguccgacuuucccauagucucaggaaauacagcucaggugccuugcacucugccccaagaauuuguuagucacuuuguggagcagcaggccccaguaagaggcgaagcagcccuccugcauuaugucgauccugacacccacaggaaccuuggggaguucaagcuguaccccgauggauuuaucacaugugugccaaauacugguggcgggccgcagaacuugccuaccaauggaguuuucguguuuagcuccugggucucucgguauuaccaacucaaacccgugggcacagcugguccagcccgucgccuguga

SEQ ID NO: 21700 - RNA, 1605 nt, Artificial Sequence
  derived and/or modified sequence opt3 from VP1__Norovirus_and/or_Norovirus-like__AB758449
augaugauggccagcaaggacgcucccuccaacauggauggcaccucuggggcaggacagcuggugccugaggucaaugccgcggaaccacucccgcuugagcccguugugggugcugccacagcagccgcuacugcaggccaaguaaaccugaucgacccuuggauuaugaauaacuucgugcaggccccagaaggggaguuuacgauaucacccaauaacaccccuggagauaucuuguucgacuuacagcugggcccacaccuaaaucccuuucuccagcaucugagucaaauguacaacgguugggucgggaauaugagagugaggguuaugcuugcuggaaacgccuucacagcgggcaaaauuaucauuugcugugugccuccaggcuuugcaagccagaauaucuccauagggcaggccacuauguucccgcacgucaucgcugaugugcggguacuggaacccauugagaucccuuuggacgauguucgcaacgugcucuuucauaccaaugagaaccgaccaacaaugcgucugcugugcaugcucuauacccccuuaagagccggaggugcaucuucgggcacugacccuuucgucauugcugggagggugcugacauguccaucacccgauuuuaauuucuuguuucuugugccgccuagcgucgaacagaagacccggcaacugacgguucccaacaucccacuaaacaaucucgccaacagucgcgugccugcgaugauaaauaaaaugacuguauccaccgaccagaaccaggugguccaguuccaaaauggaagaugcacacuggagggccagcuucuggguacuacccccgugucugccagccagguugcaaggauucgggggaagguguuuuccacagcuucaggaaaaggcuugaaccucaccgaacuggauggcacgccauaccacgccuucgagagucccgcuccuuuaggguucccagacaucggagccugugauuggcaugucagcacuuuuaagguggaccaaaaucugucuggugacccgaugucccgccucgauauuaagcagaacgcacccuucgccccucaccuuggcucaaucgaguuuacaagcgaccaggaaccaaccggggaucagcugggaacuuuggcuuggguaagucccucuacauccggcgcgcgaguugacccuuggaaaaucccaagcuaugguucgaccgugacggagucuacccaccuagcacccccgauuuucccuccaggguuuggcgaagccauagucuacuucauguccgauuuucccaucgugucaggaaauacagcucaagucccuugcacucugccccaggaguucgugagucauuuuguugaacagcaggccccaauuagaggcgaggcagcccuccugcacuauguggacccugauacccauaggaaccuuggggaguucaagcuguaccccgacggauuuaucacauguguaccaaauacugguggcgggccgcaaaacuugccuauaaauggagucuucguguuuagcuccuggguuucucgguauuaccagcucaaacccgugggcaccgcugguccagcccgucgccuguga

SEQ ID NO: 21701 - RNA, 1605 nt, Artificial Sequence
  derived and/or modified sequence opt3 from VP1__Norovirus_and/or_Norovirus-like__KX907729
augaugauggccagcaaggacgcucccuccaacauggauggcaccucuggggcaggacagcuggugccugaggucaaugccgcggaaccacucccgcuugagcccguugugggugcugccacagcaguagccacugcuggccaagugaaccugaucgacccuuggauuaugaauaacuucguccaggcaccagaaggggaguuuacgauaucacccaauaacaccccuggagauaucuuguucgacuuacagcugggcccacaccuaaaucccuuucuccagcaucugagucaaauguacaacgguuggguggggaauaugagaguuagggugaugcuugccggaaacgcuuucacagccggcaaaauuaucauuugcugugucccuccaggcuuugcgagccagaauaucuccauagggcaggcaacuauguucccgcacgugaucgccgauguacggguucuggaacccauugagaucccuuuggacgaugugcgcaacguccucuuucauaccaaugagucucgaccaacaaugcgucugcugugcaugcucuauacccccuuaagagcuggaggugccucgucaggcacugacccuuucgugauugcagggagggugcugacauguccaagccccgauuuuaacuucuuguuucuugucccgccuaguguugaacagaagacccggcaacugacggugcccaauaucccacuaaacaaccucgcuaauucccgcguaccugccaugauaaacaaaaugacugugucuaccgaccagagccaggucgugcaguuccaaaauggaagaugcacacuggagggccagcuucuggguacuacccccguuuccgcgucacagguggccaggauucgggggaaggucuuuaguacagcaagcggaaaaggcuugaaccucaccgaacuggauggcacgccauaccacgcuuucgagucucccgccccuuuaggguucccagacaucggagcuugugauuggcauguguccacuuuuaagguagaccaaaaucugucaggugacccgaugagccgccucgauauuaagcagaacgcccccuucgcaccucaccuuggcaguaucgaguuuacaucugaccaggaaccaaccggggaucagcugggaacuuuggccuggguuucccccagcacaucgggcgcucgaguggacccuuggaaaaucccaucuuaugguuccaccgucacggagucaacccaccuagcgcccccgauuuucccuccaggguuuggcgaagcaauaguguacuucaugagugauuuucccaucgucagcggaaauacagcccaagugccuugcacucugccccaggaguucguuucccauuuuguggaacagcaggcuccaauuagaggcgaggccgcacuccugcacuauguagacccugauacccauaggaaccuuggggaguucaagcuguaccccgacggauuuaucacaugugucccaaauacugguggcgggccgcaaaacuugccuauaaauggaguguucguguuuucuagcuggguuucacgguauuaccagcucaaacccgucggcaccgccgguccagcucgucgccuguga

SEQ ID NO: 21702 - RNA, 1602 nt, Artificial Sequence
  derived and/or modified sequence opt3 from VP1__Norovirus_and/or_Norovirus-like__JN899243
augaugauggccagcaaggacgcucccuccaacauggauggcaccucuggggcaggacagcuggugccugaggucaauacagccgaaccacucccgcuugagcccguugugggugcggcuacugccgcagccacggcuggccaaguaaaccugaucgacccuuggauuaugaauaacuucgugcaggcaccagaaggggaguuuaccauaucacccaauaacacaccuggagauaucuuguucgacuuaagacugggcccacaccuaaaucccuuucuccugcaucuuagucagauguacaacgguugggucgggaauaugaggauucgggugaugcuggccggaaacgcuuucagcgccggcaaaaucauuaucugcuguguuccuccaggcuuugaaucccagaauauaucuaucgggcaagcgacuauguucccgcacgugauugcagauguccgcguguuggagcccaucgagauuccucucgacgauguacgaaacguucuguaucauaccaaugaaaaccguccaacaaugagacugcucugcauguuauacacccccuugagggccggaggugcuucgucaggcacugacccuuuugugaucgccgggcggguccuuacauguccagcacccgauuucaauuuucuguuccuggugccgccuagcguggagcagaagacccgccagcuaacgauacccaacauuccacucaacaaucuggcuaacaguagagucccugccaugaucaauaaaauggcgguuuccgccgaccagaaccaagugguacaguuucagaauggaaggugcacucuugaaggccagcuguuggguaccacacccgugucugcaaaccaagucgcucggauucgcgggaagguguucagcacuaauuccggaaccggccucaaccugacagagaccgauggcacgccauaucacgccuuugagucacccgcuccuuuaggguucccagacaucggagauugugacuggcauguuuacgccuucaaagugaaucagaacacuggugacccgauguaucgacuggauaucacacagggcaauaguuuugcaccccaccucgggagcauugaguucaccucugaccaacacccuuccggagaucagcuuggcacucugacauggauaucaccauugaacaaugccagcagagucgaccccuggaagaucccuaguuacgguucuacccuaacggaauccaccaaccuggcuccacccauuuuuccgccuggguucggcgaagcgaucguguauuuuaugagcgauuucccaauaguaucgggaaauacaacucagauucccugcacccucccucaggaguuuaucucuuccuucguugaacaacaggcacccaucaggggcgaggccgcucugcuucauuacguggacccagauacacaccggaaccugggggaguuuaaguuguacccugacggauucauuacuuguguccccaacaccgguggcgggccacagaaucucccgucaaacggaguguuuaucuucaguagcugggucucccguuauuaccagcugaaaccugugggcacagccggucccgcacgcagauuauga

SEQ ID NO: 21703 - RNA, 1602 nt, Artificial Sequence
  derived and/or modified sequence opt3 from VP1__Norovirus_and/or_Norovirus-like__AB810004
augaagauggccagcaacgacgcugcacccuccaaugauggcgccgcgucucuggugccugaggcuaucaacgaaaccaugccacucgagccggucgccggggcaucaauugccgcucccguugcaggacagacaaauauaaucgacccuuggauuagaacuaacuucgugcaagccccaaauggugaauuuacgguaagucccaggaacagcccuggcgagauccuucugaauuuggaauuagggccagaucugaaccccuaccuagcucaccucucccggauguauaauggauacgccggcgguguggagguccaggugcugcuugcggggaacgcauucaccgccggaaaaauucuguuugcugccaucccuccaaauuucccgguugacaugauaucucccgcacagaucacaauguugccucaucucauuguggauguccgcacucuggagccaaucaugauuccccugccugacgugcgaaacguauuuuaucacuucaauaaccagccacaaccccguaugagacucguugcuauguuauacaccccgcugaggucgaauggcucaggcgaugacguguuuacagucagcugccgggugcuuacccgcccuacucccgauuucgaauuuaucuauuuggugccaccuagugucgaguccaagacaaaacccuucacccugccaauacuaacgauuucugaacucacuaacagcagauuucccaucccuauugagcagcuguacaccgccccaaacgagaauaacguugugcagugucagaaugggaggugcacacuugacggagaacugcaagguacuacccaguugcucuccucagcgguauguaguuaucggggccgcacaguggccaaccgaggggauaauugggaccagaaccuguuacagcugaccuacccgagcggagcaucuuacgaucccacggacgaggucccugcuccacucggcacucaagacuucuccgguauccuuuauggggugcugacacaggauaauguuucagaaggaaccggcgaggccaagaacgcuaaaggcguguacaucagcacuacaagugggaaguuuacccccaagauuggaucuauagguuugcauuccaucacggaaaauguccacccuaaccagcaaagcagauucaccccagugggcguagcccagaaugagaacacacccuuccagcaguggguucuaccgcauuaugcaggggcccuggcucucaauacuaaccuggcgccugcaguggccccaaccuuucccggagagcaacuucuguucuuuaggucgcgggucccuugcgugcagggcuugcguggucaggacgcuuucauugauugucuccugccccaggaaugggucaaucacuuuuaccaagaggccgcaccaucucaggccgacguggcuuuaauccgcuauguuaacccugauacagggagaacucuguucgaagccaaacuacacagguccggcuuuauaaccgugucacauacaggagcauacccccucguagucccaccgaacggccacuuccgguuugacaguugggugaaucaguucuauagccuggcgccuaugggguga

SEQ ID NO: 21704 - RNA, 1602 nt, Artificial Sequence
  derived and/or modified sequence opt3 from VP1__Norovirus_and/or_Norovirus-like__JN183163
augaugauggccagcaaggacgcuacccccuccgcagauggcgccacaggggcgggacagcuggugccugaggucaacacugcugacccaaucccgauugaucccguugccgguucuucaacggcacucgccaccgcuggccaagugaaucuuauagacccuuggaucauuaacaauuucguacaggcaccacagggggaauuuacaaucagucccaacaauacuccuggagaugugcuguucgacuugcaguuaggcccacaccugaaccccuuucuaagccaucucucccaaauguacaaugguugggucgggaacaugagagugaggguugugcuggccggaaaugcuuucaccgccggcaaagucauuaucugcugugugccuccaggcuuucagucucggacacuuucgauagcgcaggcaacccuguucccgcacguaaucgccgauguucgcacuuuggaccccguggaggucccucucgaagaugugcgaaacgugcuguaucauaauaacgacacacagccaaccaugcgucugcucugcauguuauacacgccccugagaacugggggagcuucagguggcaccgauagcuuugucguugccgggagggugcuuacauguccuggaccagacuucaacuuuuuguuccugguacccccgacuguggagcaaaagacccggccuuuuacaguccccaauauuccacuaaaauaucucaguaauucccgcaucccuaaccccauugaaggcaugucucugagcccagaucagacccagaacgugcaguuccaaaaugguagaugcacgaucgacgggcagccccuuggaacuacaccuguuuccgugucacagcuguguaaguuuaggggccggauaaccaguggccaacgcgucuugaaccucacugagcuggacgggagcccauucauggcauucgcugccccggcgcccgccggauuuccugauuuagguucuugcgacuggcacauugagauguccaaaaucccaaauucaagcacacagaacaaucccauugugguaaacaguguuaagccuaauucucagcaguucgugccacaucuguccagcaucacccucgaugacaacgucucgucuggcggggauuacaucggaacgauucaauggaccucucccccgucagacaguggcggugcaaauacaaacuuuuggaagauaccugauuaugggagcucccuugcugaagccucucagcuggcuccagccguguaucccccuggcuucaaugaggucaucguguacuuuauggcaagcauucccggaccaaaccagucaggcaguccuaauuugguucccugucuacugccacaggaauacaucacucacuucauauccgagcaagccccgauucagggggaggcugcgcuccugcacuacguggacccugauaccaaccgaaaucuuggagaauuuaaacuguaucccgguggcuacuugacaugcguaccaaacagcuccucaacugggccccagcagcucccucuggacggagucuucguguuugcaaguuggguuagcagauucuaucaauuaaagccagugggcaccgccuga

SEQ ID NO: 21705 - RNA, 1599 nt, Artificial Sequence
  derived and/or modified sequence opt3 from VP1__Norovirus_and/or_Norovirus-like__EU373815
augaagauggccagcaacgacgcuucccccucuucagauggcagugcaaaucuggugccugagaucaacaaugaagucauggcccucgagccaguugcgggggcugccauugcagccccgguggcuggacagcaaaacauaaucgaccccuggauuagaaauaacuucguacaggcaccugguggcgaauuuaccgugagcccaaggaaugcccccggggagguccuucugaacuugccuuuauccccagauaucaaucccuaccuggcucaccuaucucggauguauaacggauacgccggcgguguggaaguugaggugguccucgcggggaaugcauucacagccggaaaaauuaucuuugcugccgugccuccaaacuucccgcccgagaaucugucgccuucacagauaacuaugcuuccacauaucauuguagacguucgccagcuggaacccgugcgaaucccuuugccagauguccguaacaauuuuuaucacuacagcagagagaacgacaguacgcucaggcugguggcaaugcuguauaccccucuccgggcuaacaaugccggcgaugacguguucacagucuccugccgcguuuuaacuagaccgucuccugauuuugacuucauuuuucuggugcccccaaccguagaaagcaaguccaaaccuuucacaauccccauacuuaccauugaggagaugacuaacucaagguuuccagcgcccuuggaaaugaugacaaccggcccuagucaugauaucgugguccaaccacagaaugggcgguguacgauugacggagugcugcuagguacuacccagcucagcccgguuaacaucugcucuaugcgcggcgugcccacaaagcgaacuaaugggaccgauaacuguuucguccagcuggagaauccuaacggauccgccuacgacccaacagaagacauccccgcagugcuuggcucaccugauuuuguaggugaguucuaugggaccauuacgcaaagaagcccaaauaacaguacuagggcucaccccuucacacugaauaccggaucuccgcgguacacuccuaaaauaggcuccguugacauccaugugacagaugucgacgauuugaacgaccacgaaccagugaagcucacccccgucggccugagcgggucgucuggauccauucaccaguggcaguuaccuaauuacucagguguggccacgcauaacaugcaccuggcucccaguguugccccacucuuuccuggcgagcagauccuuuucuuucguagcaccgugcccgggugcggaggcuauccaaauacaaacauagauugucugauuccgcaagaguggguacagcauuucuaccaggaaggugcacccgcccgcacugacgucgcuuugcuaagauuuaucaaccccgauaccgggagggugcuguucgagugcaagcuccacaaacacggcuuuaucacaguugcguauuccggaaaucaugaccuggugaugccacccaacggcuacuuccgguuugaaucuugggucaaucaauuccacacucuugcaccuauggggaccggacgagccgaggaauga

SEQ ID NO: 21706 - RNA, 1599 nt, Artificial Sequence
  derived and/or modified sequence opt3 from VP1__Norovirus_and/or_Norovirus-like__KC473547
auggccagcaaggacgcucccaccuccccugauggcgcaucuggggccggacagcuggugccagaggcgaacacagcugaacaaaucucaauggacccggucgccggugcaaguacugccguugcuacggcaggccaggugaauaugauugaucccuggauauucaacaauuuuguacaggccccucagggggaguucaccaucagcccaaacaauacacccggagacauucucuuugaucuucaacugggcccucacuugaacccauucuuagcucaucugucccagauguacaaugguuggguggggaacaugagagucaggauccuacucgccggaaaugcguuuacugcaggcaaaauuaucauaugcugugugcccccuggcuucgacgcccggauccugaccauugcucaggccacacuuuuuccacaccugaucgcagauguucgcaccuuggaaccgguggagcucccccuggaagacguccgaaacgugcuguaucauaauucuucgcagccucaaccaacuaugcgucucguagcuauguuauacacaccccugagaaccgggggagguucaggcgggacggaugccuucguuguggcgggaaggguccuuacuugcccugccccagacuuuagcuucuuguuucuggugcccccgaguguggagcagaagacccgggucuucuccguuccuaacauuccccuaaaagaucucucuaauagccgcgugccaguaccuauccagggcauguuuaugucccccgacgugaaccagucaguccaauuccagaaugguagaugucagauagaugggcaacugcagggaacaacuccagugagucuuagccagcugugcaagauuaggggcaaaaccucuuccaacgcacggguuuugaaccucucagagguggacggcacacccuucaucccucuggaaagcccagcuccggucggguuucccgacuuaggagguugugauuggcacgugaauuucaguuuucagacccaagaccgcgauccuucucaguccguaacguucgccacuaacgacgcuagcuuuguuccauaucugggcucggugucuccccauaauggggagggauuccaggccggcgauauuaucgguucccucggguggaucucagcaccuagugacaacagccaguuuaaugucugggccauuccaaaguacggcuccucucuucaaaugagccccauacuguugcuacugugcucaccgcgacucugggaagugauccuguauuucuacaguacauuuccuggauccggccagccaagccagcuucagguccccugucuguugccucaagaguucauuacccacuuuugcaacgagcaggcucccaucgcgggggaagcagcccuccugcacuauguggauccagacacuggaagaaauuuaggugaguucaagcuguacccugauggcuuuaugacauguguucccaacucugugucaagugggccacagacccuaccgauaaauggaguauucgucuucgugagcuggguuuccagguuuuaccagcucaaaccugugggcacggcuucugccgcacggcgucuguga

SEQ ID NO: 21707 - RNA, 1599 nt, Artificial Sequence
  derived and/or modified sequence opt3 from VP1__Norovirus_and/or_Norovirus-like__GQ266692
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauucuuacgccggcgguuucgaagugcaggucauucuagcggggaacgcauuuacugccggaaaaaucauuuucgcugccgugccuccaaauuuuccgacggagggccucucgcccucacagguaaccauguucccucauaucauaguugacgugcgccaacuggagccaguccuuaucccccugccugaugugcgaaacaauuuuuaucacuacaaccagagcaaugacccaacaauuaaguugaucgcaaugcucuauacuccccugcgugcuaacaacgccggcgaugacguguucaccgucaguugcagaguucugacaaggccguccccugauuuugacuucauuuuucucgugcccccaaccguagaaucucggacuaaaccuuucagcgugcccaucuuaacagucgaggaaaugaccaauucccgcuuuccaauaccccuggagaaacuuuucacggggccuucaagugcguucgugguucagccacagaacggaagauguacuaccgaugguguguugcugggcacaacucaacuaagcccggucaauauuugcaccuuuaggggagacgugacacauaucgccgggacccaggaguacacgaugaaccucgcaucucagaauuggaacaauuaugaucccacugaagagauuccugcuccacugggcacacccgacuucguagguaagauccaggggguucuuacccaaacuacacggcgcgacggauccacccgaggccacaaggccacggugucaaccggcagcguccaguuuacaccuaagcuggggagaauccaguucaguacugauaccucuaacgacuuugaaacaggacaaaauacuagguucaccccagugggugucgugcaggauggcuccacaacccaucagaacgagccccagcaauggguuuugccgaauuacagcgggcgggacucgcacaacgugcaccucgcuccugccguagcaccaucuuuucccggagaacagcuguuauucuuucguuccacuaugccuggcuguucagguuaccccaauaugaaccuggauugccuccuuccacaggaguggguccagcauuucuaucaagaggccgcuccugcgcagagugacguggcacuguugcgcuuuguuaaucccgauacggggagagugcuauucgaauguaaacugcacaagagcggcuacgucacaguggcccauaccggacagcacgaccucguaauuccaccgaacggcuauuuuagguucgauuccugggugaaccaguucuacacucuggcuucuauggccaccuga

SEQ ID NO: 21708 - RNA, 1599 nt, Artificial Sequence
  derived and/or modified sequence opt3 from VP1__Norovirus_and/or_Norovirus-like__GQ266693
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacuccuacgccggcgguuucgaagugcaggucauucuagcggggaaugcauuuacugccggaaaaaucauuuucgcugccgugccuccaaacuuuccgacggagggccucucucccucgcagguaaccauguucccucauaucauaguugacgugcgccaacuggagccaguccuuaucccccugccugaugugcgaaauaacuuuuaucacuacaaucagucaaacgacccaacaauuaaguugaucgcaaugcucuauacuccccugcgugcuaacaaugccggcgaugacguguucaccgucagcugcagaguucugacaaggccgaguccugauuuugacuucauuuuucucgugcccccaaccguagaaucccggacuaaaccuuucucugugcccaucuuaacagucgaggaaaugaccaacagccgcuuuccaauaccccuggagaaacuuuucacggggccuuccucaacuuucgugguucagccacagaauggaagauguaccacagaugguguguugcugggcacuacccaacuaaguccggucaacauuugcacauuuaggggagacgugacccauaucgcgagcacgcggguauacacuaugaaucucgccucucagaacuggaauaacuaugaucccacagaggaaauuccugcaccacuggggacccccgacuucguuggcaagauccagggugugcuuacucagacaacccgcggggacggauccacgcgaggccacaaggcuaccgucucaacaggcagcguggaguuuacuccuaagcuggggagaauccaauucaguaccgauacaucuaaugacuuugaaacuggacagaacaccagguucacaccagucggugugauucaggauggcaauaccacucaucaaaacgagccccagcagugggccuugccgaauuacuccgggagcggaucgcacaacguucaccucgcuccugccguggcaccaucuuuucccggcgaacagcuguuauucuuucgguccacgaugccugguuguucaggguaccccaauaugaaccuggagugccuccuuccacaagaguggguacagcauuucuaucaggaagccgcuccugcgcagagugacgucgcacuguugcguuuugugaaccccgauacaggccgcguucuauucgaguguaaacugcacaagagcggauacgugaccgucgcccauacuggccaacacgaccucgugauaccaccgaauggguauuuuagauucgauuccuggaucaaccaguucuacacccuggcuucuauggccacauga

SEQ ID NO: 21709 - RNA, 1599 nt, Artificial Sequence
  derived and/or modified sequence opt3 from VP1__Norovirus_and/or_Norovirus-like__EU004673
augagaaugagcgacggcgccgcucccaaggcauccgggucugaggccucaggacaggaucuggugccuaccgcggucgaacaagcuguuccaauccagccgguggccggugcagcccucgcugcacccgccgcuggccagauuaaccagauagacccuuggaucuuccaaaauuuuguacagugcccacuuggggaguucaguauuagccccaggaacacaccuggagaaauccuguuugauuuggccuuaggcccaggucugaaucccuaccuagcgcaccucuccgcaauguauacugggugggugggaaacauggagguccagcuggugcuugccggcaaugcuuucacggccggcaaaguuguggucgcacuggugccuccauacuuuccgaaggggucuuugaccacagcucagauuacuuguuucccccauguaaugugcgacguucggacccucgaaccuauccaacugccacugcucgaugugcgccgagucuuauggcacgccacacaggaccaggaggagucgaugcgucugguguguaugcuuuauacccccuugagaacuaacucaccuggagaugagagcuuuguggucagugguaggcugcuauccaaaccagcggccgacuucaauuuuguuuaccucacacccccgauagaacggaccaucuaucgcaugguggaucugccuguacuucagcccagacugugcacgcaugcaagguggccagcuccuguguacggcuugcucgucgaccccucucugccaagcaacccccaauggcagaaugggcgggugcacauugauggaacuuuacugggcaccacaccuguuuccgguucaugggugaguuguuucgccgcugaagccgcauaugaguuucagagcgggacuggagaggucgccaccuucacacucaucgaacaagacggcucugcuuacgugccaggcgaucgcgcggcaccgcuuggguaccccgacuuuuccggacagcuggagauugaaguacagaccgagacgacucgagccggugacaaguugaaaguuacaaccuucgaaaugauccuaggcccuacuacaaacguggaucaggcuccauaucaagggagagucuacgccucacugaccgcagccgcuagccucgaccugguggauggaaggguccgggccgugccccguaguauauauucuuuccaggacguucuuccugaguacaaugauggccuguuggugccacucgcacccccgauugguccuuuucugccaggggagguauuacugcgcuucagaacguauaugaggcaggucgacuccagcgaugcggcugccgaagcaaucgacugcgcccuaccccaggaguuugugucgugguucgcuucuaacggcuuuaccguucaauccgaagcccuccugcuucgguaccgaaauacauugacuggacagcuccuguucgaguguaagcuguauucagaaggcuacauugcacuuaguuacagcggguccggaccucugaccuuucccacagaugguuucuuugagguggucucuugggugccacgcuuguuccagcucgcuagcguaggcucauga

SEQ ID NO: 21710 - RNA, 1599 nt, Artificial Sequence
  derived and/or modified sequence opt3 from VP1__Norovirus_and/or_Norovirus-like__AB601769
augagaaugagcgacggcgccgcucccaaggcaaacggguccgaggccucuggacaggaucuggugcucaccgcggucgaacaagcuguuccuauccagccaguggccggugcagcccuugcugcaccggccgcuggccagauuaaucagauagaccccuggaucuuccaaaacuuuguacagugcccucugggggaguucucaauuaguccaaggaauacacccggagaaaucuuguuugauuuagcccugggcccuggucuaaacccauaccucgcgcaccugagcgcaauguauacugggugggugggaaauauggagguccagcuugugcuggccggcaacgcuuucacggccggcaaaguuguggucgcauuggugcccccuuacuuuccaaaggggucccucaccacagcucagauuacuuguuucccgcauguaaugugcgacguucggacccuggaacccauccaacugccucucuuagaugugcgccgaguccuguggcacgccacacaggaccaggaggagucuaugcgucuuguguguauguuguauaccccacugagaacuaauucgcccggagaugaaucauuuguggucagcgguaggcuacucaguaaaccugcggccgacuucaacuuuguuuaccugacaccacccauagagcggaccaucuaucgcaugguggaucuuccgguacugcagccuagauugugcacgcaugcaagguggcccgcuccaguguacggccuccuggucgacccuuccuuacccucuaauccacaauggcagaacgggcgggugcacguugauggaacucugcucggcaccacacccgugagcgguuccugggucucauguuucgccgcugaagccgcauaugaguuucagagugggacuggagagguggccaccuucacacuuauugaacaagacggcagcgcuuacguaccuggcgagcgcgcggcaccacugggguacccggauuuuucuggacaguuggaaaucgagguucagaccgaaacgacuaagcgaggugagaaacuaaaggugacaaccuucgagaugauucugggccccacuacaaaugucgaccaggccccuuaucaagggagaguguacgcuucccucucagccgcagccagccuggaccuugucgauggaagggugcgggcuguuccacguaguaucuauggcuuccaggacgugauacccgaauacaacgauggucuguugguaccucucgccccacccauugggccguuucugccuggcgaggucuuacugcgcuucagaaccuauaugaggcaaguggacucuuccgaugcagcggcugaagccaucgacugcgcacuaccacaggaguuuguuagcugguucgccucgaauggauuuacggugcagucugaagcucuccugcuucgguaccgaaacaccuugacaggccagcuccuguucgaguguaagcuguauuccgagggguacauugcccuuucauacaguggaagcgguccccugacuuuuccuaccgauggcuucuuugaagucguguccuggguaccccgcuuguaucagcucgcaucuguggggagcuga

SEQ ID NO: 21711 - RNA, 1599 nt, Artificial Sequence
  derived and/or modified sequence opt3 from VP1__Norovirus_and/or_Norovirus-like__EU004676
augagaaugagcgacggcgccgcucccaaggcaaacggguccgaggccucuggacaggaucuggugccuaccgcggucgaacaagcuguuccaauccagccgguggccggugcagcccucgcugcacccgccgcuggccagauuaaucagauagacccuuggaucuuccaaaacuuuguacagugcccacuuggggaguucucaauuagucccaggaauacaccuggagaaauccuguuugauuuggccuuaggcccaggucugaaccccuaccuagcgcaccucagcgcaauguauacugggugggugggaaauauggagguccagcuggugcuugccggcaacgcuuucacggccggcaaaguuguggucgcacuggugccuccauacuuuccgaagggguccuugaccacagcucagauuacuuguuucccccauguaaugugcgacguucggacccucgaaccuauccaacugccacugcucgaugugcgccgagucuuauggcacgccacacaggaccaggaggagucuaugcgucugguguguaugcuuuauacccccuugagaacuaauucgccuggagaugaaucauuuguggucagcgguaggcugcuaaguaaaccagcgcccgacuucaacuuuguuuaccucacaccgccuauagagcggaccaucuaucgcaugguggaucugcccguacuucagccaagacugugcacgcaugccagguggccugcacccguguacggcuugcucgucgacccaucccugcccucuaauccucaauggcagaacgggcgggugcagguugauggaacuuuacugggcaccacaccagugagcgguuccugggucucauguuucgcugccgaagcugccuaugaguuucaagcagggacuggagaggugguaaccuucacaaugauugaacaggacggcagugccuacguuccgggcgaucgcgcugcgccccucggguacccugacuuuagcggacagcuugagaucgaagugcagaccgagacgacuaagacaggugacaaacugcgagucaccacuuucgaaaugauuuugggcccaacaaccaauguggaucaagcacccuaucaggggagagccuacgcuucucuaacggccgcagccucccuggaccucgucgauggaagggugcgggcuguuccucguucaaucuauagcuuccaggacgagcugccagaguacaacgauggccuucuggugcccuuggccccgccucucgguccauuucugcccggggaaguauuacugcgcuucagaaccuauaugaggcagcuagacacagcagaugcggcugcccaaccuauagacugcgcacucccccaggaguuuauuaguugguucgccucuaauaacuuuacuguccaguccgaugcucugcuugugcgguaccgaaauaccuugacaggccagcuccuguucgaagccaagcuguauagcgagggauacaucgcaguuucguacucuggcuccgggccacuuacuuuuccuaccgacggauucuuugaaguggucucaugggugccccgccuguuccaauuggcuaguguagguagcuga

SEQ ID NO: 21712 - RNA, 1599 nt, Artificial Sequence
  derived and/or modified sequence opt3 from VP1__Norovirus_and/or_Norovirus-like__JQ237823
augagaaugagcgacggcgccgcucccaaggcaaacggguccgaggccucuggacaggaucuggugccuaccgcggucgaacaagcuguuccaauccagccgguggccggugcagcccucgcugcacccgccgcuggccagauuaaucagauagacccuuggaucuuccaaaacuuuguacagugcccacuuggggaguucucaauuagucccaggaauacaccuggagaaauccuguuugauuuggccuuaggcccaggucugaaccccuaccuagcgcaccucagcgcaauguauacugggugggugggaaauauggagguccagcuggugcuugccggcaacgcuuucacggccggcaaaguuguggucgcacuggugccuccauacuuuccgaagggguccuugaccacagcucagauuacuuguuucccccauguaaugugcgacguucggacccucgaaccuauccaacugccacugcucgaugugcgccgagucuuauggcacgccacacaggaccaggaggagucuaugcgucugguguguaugcuuuauacccccuugagaacuaauucgccuggagaugaaucauuuguggucagcgguaggcugcuaaguaaaccagcgcccgacuucaacuuuguuuaccucacaccgccuauagagcggaccaucuaucgcaugguggaucugcccguacuucagccaagacugugcacgcaugccagguggccugcacccguguacggcuugcucgucgacccaucccugcccucuaauccucaauggcagaacgggcgggugcagguugauggaacuuuacugggcaccacaccagugagcgguuccugggucucauguuucgcugccgaagcugccuaugaguuucaagcagggacuggagaggugguaaccuucacaaugauugaacaggacggcagugccuacguuccgggcgaucgcgcugcgccccucggguacccugacuuuagcggacagcuugagaucgaagugcagaccgagacgacuaagacaggugacaaacugcgagucaccacuuucgaaaugauuuugggcccaacaaccaauguggaucaagcacccuaucaggggagagccuacgcuucucuaacggccgcagccucccuggaccucgucgauggaagggugcgggcuguuccucguucaaucuauagcuuccaggacgagcugccagaguacaacgauggcgugcuuguaccccuggccccgccuuuggguccauuucuccccggggaaguccuguuacgcuucagaaccuauaugaggcagcuggacacagcagaugcggcugcccaaccuauagacugcgcacuaccccaggaguuuauuaguugguucgccucuaauaacuuuacugugcaguccgaugcucuccugguucgguaccgaaauacccuuacaggccaguugcuguucgaagccaagcucuauagcgagggauacaucgcagugucguacucuggcuccgggccacugacuuuuccuaccgacggauucuuugaagucgugucauggguaccccgccuuuuccaacuggcuaguguggguagcuga

SEQ ID NO: 21713 - RNA, 1599 nt, Artificial Sequence
  derived and/or modified sequence opt3 from VP1__Norovirus_and/or_Norovirus-like__DQ223043
augagaaugagcgacggcgccgcucccaaggcaaacggguccgaggccucuggacaggaucuggugccuaccgcggucgaacaagcuguuccaauccagccgguggccggugcagcccucgcugcacccgccgcuggccagauuaaucagauagacccuuggaucuuccaaaacuuuguacagugcccacuuggggaguucucaauuagucccaggaauacaccuggagaaauccuguuugauuuggccuuaggcccaggucugaaccccuaccuagcgcaccucagcgcaauguauacugggugggugggaaauauggagguccagcuggugcuugccggcaacgcuuucacggccggcaaaguuguggucgcacuggugccuccauacuuuccgaagggguccuugaccacagcucagauuacuuguuucccccauguaaugugcgacguucggacccucgaaccuauccaacugccacugcucgaugugcgccgagucuuauggcacgccacacaggaccaggaggagucuaugcgucugguguguaugcuuuauacccccuugagaacuaauucgccuggagaugaaucauuuguggucagcgguaggcugcuaaguaaaccagcguccgacuucaacuuuguuuaccucacacccccgauagagcggaccaucuaucgcaugguggaucugccuguacuucagcccagacugugcacgcaugccagguggccagcaccuguguacggcuugcucgucgaccccucucugccaagcaauccccaauggcagaacgggcgggugcacguugauggaacuuuacugggcaccacaccuguguccgguucaugggucaguuguuucgcugccgaagcugccuaugaguuucagagcgggacuggagagguggcaaccuucacaaugauugaacaagacggcucugccuacguaccaggcgaucgcgcugcgccgcucggguaccccgacuuuuccggacagcuugagaucgaaguucagaccgagacgacuaagacaggugacaaacugaaggugaccacuuucgaaaugauuuugggcccuacaaccaaugucgaucaggcaccauaucaagggcgagccuacgcuucacuaacggccgcagccagccuggaccucguggauggaagagucagggcugugccccggaguguuuauucuuuccaggacgagcugccugaguacaacgauggccuucuggugccauuggcacccccgcucgguccuuuucugccaggggaaguauuacugcguuuccgcaccuauaugagacagcuagacacagccgaugcguccgcucagcccaucgacugcgcccucccucaagaguuuauaagcugguucgcaucgaauaacuuuacuguccagucugaugcccugcuugugagguaccggaauaccuugacaggccagcuccuguucgaagcuaagcuguauuccgagggauacauugccguuucauacaguggcagcgggccccuuacuuuuccaaccgacggauucuuugaaguggucuccugggugccucgacuguuccaguuggcaucuguagguagcuga

SEQ ID NO: 21714 - RNA, 1599 nt, Artificial Sequence
  derived and/or modified sequence opt3 from VP1__Norovirus_and/or_Norovirus-like__JX048594
augagaaugagcgacggcgccgcucccaaggcaaacggguccgaggccucuggacaggaucuggugccuaccgcggucgaacaagcuguuccaauccagccgguggccggugcagcccucgcugcacccgccgcuggccagauuaaucagauagacccuuggaucuuccaaaacuuuguacagugcccacuuggggaguucucaauuagucccaggaauacaccuggagaaauccuguuugauuuggccuuaggcccaggucugaaccccuaccuagcgcaccucagcgcaauguauacugggugggugggaaauauggagguccagcuggugcuugccggcaacgcuuucacggccggcaaaguuguggucgcacuggugccuccauacuuuccgaagggguccuugaccacagcucagauuacuuguuucccccauguaaugugcgacguucgggcccucgaaccuauccaacugccacugcucgaugugcgccgagucuuauggcacgcgacccaggaccaggaggagucuaugcgucugguguguaugcuuuauacacccuugagaaccaauucgccuggagaugaaucauuuguggucagcgguaggcugcuaaguaaaccagccgcagacuucaacuuuguuuaccucacucccccgauagagcggacaaucuaucgcaugguggaucugccuguacuucagcccagacugugcacccaugcuagguggccagccccuguguacggcuugcucgucgaccccucccugccaucuaauccccaauggcagaacgggcgggugcacguugauggaacguuacugggcacuaccccugugagcgguuccugggucucauguuucgcugccgaagcagccuaugaguaccagagugaggugggggaaguagcuacauuuacucucauugagcaagacggaagcgcguacguuccaggcgaucgcgcagccccgcuuggcuaucccgacuacucugggcagcuggaaaucgaggugcagaccgaaacaaccaagacgggagacaaauugaaggucacuacauucgauaugauucuagguccuaccacuaauguggaccaggucccauaucaaggcaagguguacgcuucccugacaaccgccucaagccucgaucugguugacgggcgagcaagagccgugcccaggaguguauauucuuuucaggauguccuuccugaguacaacgacggacuguuggugccacucgcucccccgcugggcccuuauuuaccaggugagguucugcuacgguuccguacguacaugcgccagcucgauaccgccgacgcagcggcucagcccaucgauugcgcccugccucaagaguucauauccugguuugcaagcaauaacuucacagugcagucggacgcccuuuugauuagauacaggaauacucugaccgggcagcuccuguuugaagcuaaacuuuauucugaaggcuacaucgccgucuccuauucaggaaguggcccccugacauucccaacugauggguuuuucgaggugguaagcugggugccucgguuguuucagcucgcauccguuggaucuuga

SEQ ID NO: 21715 - RNA, 1596 nt, Artificial Sequence
  derived and/or modified sequence opt3 from VP1__Norovirus_and/or_Norovirus-like__GQ266691
augaagauggccagcuccgacgcuaaccccucugauggcucaaccgcaagucuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuagcccaaggaacgcacccggggagauccuuugguccgccccucugggaccagauuugaaucccuacuuaucucaccuggcucggauguauaacggcuacgccgguggguucgaagugcaggucauucuagcgggaaaugcauuuacugccggcaaaaucauuuucgcugccgugccuccaaacuuuccgacggagggccucucgcccucacagguaaccauguucccucauaucauaguugacgugcgccaacuggagccaguccuuaucccccugccugaugugcgaaauaacuuuuaucacuacaaucagagcaacgacccaacaauuaaguugaucgcaaugcucuauacuccccugcgugcuaauaacgccggggaugacguguucaccgucaguugcagaguucugacaaggccguccccugauuuugacuucauuuuucucgugcccccaaccguagaaucucggacuaaaccuuucagcgugcccaucuuaacaauagaggaaaugaccaacucccgcuuuccaauuccccuggagaaacuuuucacgggaccuucaagugcguucgucgugcagccacagaaugguagauguacuaucgauggcguuuugcuggggaccacacaacuaagcccggugaacauuugcacuuuuaggggagacgucacccauaucgagggcucuaagguguacacaaugaaucucgccucccagaacuggaauaacuaugaucccaccgaagagaucccugcaccacuggguacgcccgacuucaaggggcggauucagggaguacuuacucagacaacccgcucagacggcagcacucgaggccacacagcuaccguuaguacggggucugccgaauuuaccccuaagcugggaagaauacaauucuccacagauacuaauaacgacuuugagaccggucagaauacaaaauucacuccagugggcgucgugcagaacgggagcaccacacaucaaaaugaaccccagcagugggaguugccggauuacucgggaaggggcauccacaacguccaccucgcuccugccguggcaccaaccuaccccggugagcagauucuguuuuuccggucuacuaugccuggguguuccggcuaucccaauaugaacuuagacugccugcucccacaagauuggguucgucauuuuuaccaggaagccgcuccugcgcagucagacguggcacuucugcgcuucguaaaucccgauacgggaagagucuuguuugaguguaagcuacacaaaaguggcuaugugacaguugcccauaccgggcagcacgaccuggugaucccaccgaacggauacuucagguuugauagcugggucaaccaauucuauacucucgcuccuauggguuga

SEQ ID NO: 21716 - RNA, 1596 nt, Artificial Sequence
  derived and/or modified sequence opt3 from VP1__Norovirus_and/or_Norovirus-like__GQ266690
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauucuuacgccggcgguuucgaagugcaggucauucuagcggggaacgcauuuacugccggaaaaaucauuuucgcugccgugccuccaaauuuuccgacggagggccucucgcccucacagguaaccauguucccucauaucauaguugacgugcgccaacuggagccaguccuuaucccccugccugaugugcgaaacaauuuuuaucacuacaaccagagcaaugacccaacaauuaaguugaucgcaaugcucuauacuccccugcgugcuaacaacgccggcgaugacguguucaccgucaguugcagaguucugacaaggccguccccugauuuugacuucauuuuucucgugcccccaaccguagaaucucggacuaaaccuuucagcgugcccaucuuaacagucgaggaaaugaccaauucccgcuuuccaauaccccuggagaaacuuuucacggggccuucaagugcguucgugguucagccacagaacggaagauguacuaccgaugguguguugcugggcacaacucaacuaagcccggucaauauuugcaccuuuaggggagacgugacacauaucgccgggacccaggaguacacgaugaaccucgcaucucagaauuggaacaauuaugaucccacugaagagauuccugcuccacugggcacacccgacuucguaggucggauccaggggguucuuacccaaacuacacgccgagacggauccaccagaggccacaaggccacggugucaaccggcagcguccauuuuacaccuaagcuggggaggauccaguucaguacugauaccucuaacgacuuugaaacaggacagaauacucgguucaccccagugggugucgugcaagauggcgggacaacccaccagaacgagccccagcaguggguuuugccgaauuacuccggacgugacggccacaacgugcaucucgcuccugccguagcacccagcuuuccaggugaacaaauucuguucuuucgcucgacuaugccuggguguucuggcuaccccaauaugaacuuagauugccugcucccacaggaguggguccagcacuucuaucaggaggccgcuccugcgcaauccgacguggcacuucugagauuuguuaaucccgauacgggaaggguguuguucgaauguaagcuacauaaaucaggcuacgucacaguggcccacaccgggcagcacgaccugguaauaccaccgaacggauauuuucgguucgauaguugggugaaccaguucuacacucucgcuccuauggguuga

SEQ ID NO: 21717 - RNA, 1596 nt, Artificial Sequence
  derived and/or modified sequence opt3 from VP1__Norovirus_and/or_Norovirus-like__JN183164
augaugauggccagcaaggacgcucccaccaacauggauggcacauccggggcaggacagcuggugccugaggucucuacugccgaaccaaucucaauggagccgguugcgggugcugccacggcagccgcuaccgcaggccaagugaauaugauugaccccuggauaaugaguaacuacguacaggccccucagggggaguucacaaucagcccaaauaacacucccggagauauucucuuugaccuucagcugggcccucacuugaauccauucuuaucccaucuggcucaaauguauaacgguuggguggggaauaugaaagucagagugcuacucgccggaaacgcguuuaccgcaggcaagaucauuaucucuugcguucccccuggcuucgccgcucagaaugugucgauagcccaggcaacaauguuuccacacgucaucgcugaugugaggguacuggaaccgauugaaguuccccuugaggacgugcggaacguccuguuccauaauaacgauucaaccccuacuaugcgcuugaucuguaugcucuacacaccacugcgagccagcgggaguuccucuggaaccgaccccuuugugauugcgggucgugugcugacgugcccuagcccagauuucaauuuucucuucuuaguucccccgaacguugagcagaaaacuaagccuuuuuccgugcccaaucugccacuuaacguauugucaaacaguagagugccuagccugaucaaaucuaugauggucucccaagaccacggccagauggugcaguuccagaaugggaggguuacccuagauggacaacuccagggcacaacucccaccucagccagccagcuguguaagauacgggguacaguguaucaugcaaccgggggacaaggccuuaaccugacggaaauugacggcacuccauaccacgcuuuugagagucccgccccuaucggguucccagauuugggagaaugcgacuggcacauuaaugcuucuccggccaacgcauucacagacgguuccaucauccaucgcauugaugucgcccaggacagcaccuuugcuccccaccucggcacuauacauuauacaaaugcggauuacaacgcaaauguggggcugaucuguucguuagaguggcugucuccuccauccggaggcgcccccaagguaaacccuugggcuauuccaagauaugguucaacccucacggaggccgcacagcuugcucccccgaucuacccuccaggguucggcgaagccauagucuuuuucaugagugacuuucccauugccaauggaagcgauggccuguccgugccuugcaccaucccccaggaguucgucacacacuuugugaacgaacaagcaccaacuaggggagaggcggcuuugcuacacuacgucgacccugauacccaucggaaucugggggaguucaaacucuaucccgaagguuuuaugacaugugugccaaacucuagcggcucagggccgcagacucugccuaucaauggaguuuucaccuuuauuaguugggugucccgcuucuaccagcuuaagcccguaggcacauga

SEQ ID NO: 21718 - RNA, 1596 nt, Artificial Sequence
  derived and/or modified sequence opt3 from VP1__Norovirus_and/or_Norovirus-like__AB809995
augaagauggccagcaacgacgcugcacccuccaaugauggcgccgcgucucuggugccugaggcuaucaacgaaaccaugccacucgagccggucgccggggcaucaauugccgcucccguugcaggacagacaaauauaaucgacccuuggauuagaacuaacuucgugcaagccccaaauggugaauuuacgguaagucccaggaacagcccuggcgagauccuucugaauuuggaauuagggccagaucugaaccccuaccuagcucaccucucccggauguauaauggauacgccggcgguguggagguccaggugcugcuugcggggaacgcauucaccgccggaaaaauucuguuugcugccaucccuccaaauuucccgguugacaugauaucucccgcacagaucacaauguugccucaucucauuguggauguccgcacucuggagccaaucaugauuccccugccugacgugcgaaacguauuuuaucacuucaauaaccagccacaaccccguaugagacucguugcuauguuauacaccccgcugaggucgaauggcucaggcgaugacguguuuacagucagcugccgggugcuuacccgcccuacucccgauuucgaauuuaucuauuuggugccaccuagugucgaguccaagacaaaacccuucacccugccaauacuaacgauuucugaacucacuaacagcagauuucccaucccuauugagcagcuguacaccgccccaaacgagaauaacguugugcagugucagaaugggaggugcacacuugacggagaacugcaagguacuacccaguugcucuccucagcgguauguaguuaucggggccgcacaguggccaacagcggggauaauugggaccagaaccuguuacagcugaccuacccgucuggagcauccuacgaucccacggacgaggucccugcuccacucggcacucaagacuucucagguauccuuuauggggugcugacacaggauaauguuagcgaaggaaccggcgaggccaagaacgcuaaaggcguguacaucaguacuacaucugggaaguuuacccccaagauuggauccauagguuugcauagcaucacggaaaauguccacccuaaccagcaaucgcgauucaccccagugggcguagcccagaaugagaacacacccuuccagcaguggguucuaccgcauuaugcaggggcccuggcucucaauacuaaccuggcgccugcaguggccccaaccuuucccggagagcaacuucuguucuuuagaucuagggucccuugcgugcagggcuugcggggucaggacgcuuucauugauugucuccugccccaggaaugggucaaucacuuuuaccaagaggccgcaccaucccaggccgacguggcuuuaauccguuauguuaacccugauacagggcgcacucuguucgaagccaaacuacacagaucaggcuuuauaaccgugagucauacaggagcauacccccucguagucccaccgaacggccacuucagguuugacagcugggugaaucaguucuauucccuggcgccuuga

SEQ ID NO: 21719 - RNA, 1593 nt, Artificial Sequence
  derived and/or modified sequence opt3 from VP1__Norovirus_and/or_Norovirus-like__KT732275
augaagauggccagcaacgacgcugcacccuccaaugauggcgccgcggggcuggugccugagggaaacaaugaaacccucccacuugagccggucgcuggugccgcaaucgccgcucccguuacaggccagaacaauauuauagacccuuggaucagaacuaacuucgugcaagcaccaaauggggaauuuacgguaucucccaggaacucaccuggagagauucuguugaauuuagaacugggcccagaucuaaaccccuaccucgcccaccugagucggauguauaaugguuacgcugggggaguggagguccaggugcuucuggccggcaacgcguucaccgcaggcaaaaucuuguuugccgcuguuccuccaaauuucccgguggaguuucucagccccgcccagauuacaaugcugccucaucugaucgucgacgugcgcacucucgaaccaauaaugauccccuuaccugauguacgaaacaccuucuuucacuauuccaaucagccaaacucucguaugagacugguugcaaugcuuuacacacccuugaggucgaacgggucaggagacgauguguucaccgucagcugccgggugcugacucgcccgacaccugacuuugaguucaccuaucuagugcccccaagugucgaauccaagacgaaaccuuuuucucuccccauucugacucuuagcgagcugaccaauuccagauucccaguucccaucgauucauuguuuacagcucaaaacaaugugcuccagguacagugucagaacgguaggugcacucuggacggcgaguuacaagggaccacacagcugcucccuaguggaauuugugccuuccggggccgcgugaccgcgcagaucaaucagcgagauagauggcauaugcaacuucagaaccugaaugguacgacuuacgacccaacagaugacgucccggcccccuuggggaccccugacuucaagggagugguuuuuggcauggugagccagaggaacgucggcaaugaugcaccagggucuacucgggcucaacaggccuggguguccacauauucaccccaguucguaccuaaacuaggaagcguuaaccugcguauaagugacaaugaugacuuucaguuccaaccaaccaaguuuacgcccgugggugucaacgaugacgaugacggccacccguuccgccagugggaacucccuaauuacucuggggagcugacccuuaacaugaaucuggcuccacccguggccccuaacuuucccggagaacagcucuuguucuuuagauccuucgucccaugcagcggcgguuacaaccaggggauuaucgauugucugauuccucaagaguggauccagcauuuuuaucaggaaucggcacccucucaguccgacguggccuuaaucagguacguuaauccagauacaggccggacucuguucgaggcuaagcuacaccgaucaggauauauuaccguggcgcacaguggcgacuacccgcucguagucccugcaaacgggcauuuucgcuucgacagcugggugaaucaauucuauucccuggcccccauguga

SEQ ID NO: 21720 - RNA, 1593 nt, Artificial Sequence
  derived and/or modified sequence opt3 from VP1__Norovirus_and/or_Norovirus-like__AB809998
augaagauggccagcaacgacgcugcacccuccaaugauggcgccgcgucucuggugccugaggcuaucaacgaaaccaugccacucgagccggucgccggggcaucaauugccgcucccguugcaggacagacaaauauaaucgacccuuggauuagaacuaacuucgugcaagccccaaauggugaauuuacgguaagucccaggaacagcccuggcgagauccuucugaauuuggaauuagggccagaucugaaccccuaccuagcucaccucucccggauguauaauggauacgccggcgguguggagguccaggugcugcuugcggggaacgcauucaccgccggaaaaauucuguuugcugccaucccuccaaauuucccgguugacaugauaucucccgcacagaucacaauguugccucaucucauuguggauguccgcacucuggagccaaucaugauuccccugccugacgugcgaaacguauuuuaucacuucaauaaccagccacaaccccguaugagacucguugcuauguuauacaccccgcugaggucgaauggcucaggcgaugacguguuuacagucagcugccgggugcuuacccgcccuacucccgauuucgaauuuaucuauuuggugccaccuagugucgaguccaagacaaaacccuucacccugccaauacuaacgauuucugaacucacuaacagcagauuucccaucccuauugagcagcuguacaccgccccaaacgagaauaacguugugcagugucagaaugggaggugcacacuugacggagaacugcaagguacuacccaguugcucuccucagcgguauguaguuaucggggccgcacaguggccaacagcggggauaauugggaccagaaccuguuacagcugaccuacccgucuggagcauccuacgaucccacggacgaggucccugcuccacucggcacucaagacuucucagguauccuuuauggggugcugacacaggauaauguuagcgaagccaccggagaggcuaagaacgccaaaggcguguacaucaguacuacaucuggcaaguuuacccccaagauuggguccauaggauugcauagcaucacggaaaauguccacccuaaccagcaaucgcgauucaccccaguggguguagcacagaaugagaacacacccuuccagcaguggguucuaccgcauuaugccggcgcucuggcgcucaauacuaaccuggccccugcaguggcuccaaccuuucccggggagcaacuucuguucuuuagaucuagggucccuugcgugcagggauugcggggccgugacgccuucauugauugucuccugccccaggaaugggucaaucacuuuuaccaggaggcagccccaucccaagcugacguggccuuaauccgcuauguuaacccugauacagguagaacucuguucgaagcaaaacuacacaggucaggguuuauaaccgugagucauacaggcgcguacccccucguagucccaccgaacggacacuuccgguuugacagcugggugaaucaguucuauucccuggcuuga

SEQ ID NO: 21721 - RNA, 1593 nt, Artificial Sequence
  derived and/or modified sequence opt3 from VP1__Norovirus_and/or_Norovirus-like__AB809984
augaagauggccagcaacgacgcugcacccuccaaugauggcgccgcgucucuggugccugaggcuaucaacgaaaccaugccacucgagccggucgccggggcaucaauugccgcucccguugcaggacagacaaauauaaucgacccuuggauuagaacuaacuucgugcaagccccaaauggugaauuuacgguaagucccaggaacagcccuggcgagauccuucugaauuuggaauuagggccagaucugaaccccuaccuagcucaccucucccggauguauaauggauacgccggcgguguggagguccaggugcugcuugcggggaacgcauucaccgccggaaaaauucuguuugcugccaucccuccaaauuucccgguugacaugauaucucccgcacagaucacaauguugccucaucucauuguggauguccgcacucuggagccaaucaugauuccccugccugacgugcgaaacguauuuuaucacuucaauaaccagccacaaccccguaugagacucguugcuauguuauacaccccgcugaggucgaauggcucaggcgaugacguguuuacagucagcugccgggugcuuacccgcccuacucccgauuucgaauuuaucuauuuggugccaccuagugucgaguccaagacaaaacccuucacccugccaauacuaacgauuucugaacucacuaacagcagauuucccaucccuauugagcagcuguacaccgccccaaacgagaauaacguugugcagugucagaaugggaggugcacacuugacggagaacugcaagguacuacccaguugcucuccucagcgguauguaguuaucggggccgcacaguggccaacagcggggauaauugggaccagaaccuguuacagcugaccuacccgucuggagcauccuacgaucccacggacgaggucccugcuccacucggcacucaagacuucucagguauccuuuauggggugcugacacaggauaauguuagcgaaggaaccggcgaggccaagaacgcuaaaggcguguacaucaguacuacaucugggaaguuuacccccaagauuggauccauagguuugcauagcaucacggaaaauguccacccuaaccagcaaucgcgauucaccccagugggcguagcccagaaugagaacacacccuuccagcaguggguucuaccgcauuaugcaggggcccuggcucucaauacuaaccuggcgccugcaguggccccaaccuuucccggagagcaacuucuguucuuuagaucuagggucccuugcgugcagggcuugcggggucaggacgcuuucauugauugucuccugccccaggaaugggucaaucacuuuuaccaagaggccgcaccaucccaggccgacguggcuuuaauccguuauguuaacccugauacagggcgcacucuguucgaagccaaacuacacagaucaggcuuuauaaccgugagucauacaggagcauacccccucguagucccaccgaacggccacuucagguuugacagcugggugaaucaguucuauucccuggcguga

SEQ ID NO: 21722 - RNA, 1590 nt, Artificial Sequence
  derived and/or modified sequence opt3 from VP1__Norovirus_and/or_Norovirus-like__KT732276
augaagauggccagcaacgacgcugcacccuccaaugauggcgccgcggggcuggugccugagggaaacaaugaaacccucccacuugagccggucgcuggugccgcaaucgccgcucccguuacaggccagaacaauauuauagacccuuggaucagaacuaacuucgugcaagcaccaaauggggaauuuacgguaucucccaggaacucaccuggagagauucuguugaauuuagaacugggcccagaucuaaaccccuaccucgcccaccugagucggauguauaaugguuacgcugggggaguggagguccaggugcuucuggccggcaacgcguucaccgcaggcaaaaucuuguuugccgcuguuccuccaaauuucccgguggaguuucucagccccgcccagauuacaaugcugccucaucugaucgucgacgugcgcacucucgaaccaauaaugauccccuuaccugauguacgaaacaccuucuuucacuauuccaaucagccaaacucucguaugagacugguugcaaugcuuuacacacccuugaggucgaacgggucaggagacgauguguucaccgucagcugccgggugcugacucgcccgacaccugacuuugaguucaccuaucuagugcccccaagugucgaauccaagacgaaaccuuuuucucuccccauucugacucuuagcgagcugaccaauuccagauucccaguucccaucgauucauuguuuacagcucaaaacaaugugcuccagguacagugucagaacgguaggugcacucuggacggcgaguuacaagggaccacacagcugcucccuaguggaauuugugccuuccggggccgcgugaccgcgcagaucaaucagcgagauagauggcauaugcaacuucagaaccugaaugguacgacuuacgacccaacagaugacgucccggcccccuuggggaccccugacuucaagggagugguuuuuggcauggugagccagaggaacgucggcaaugaugcaccagggucuacucgggcucaacaggccuggguguccacauauucaccccaguucguaccuaaacuaggaagcguuaaccugcguauaagugacaaugaugacuuucaguuccaaccaaccaaguuuacgcccgugggugucaacgaugacgaugacggccacccguuccgccagugggaacucccuaauuacucuggggagcugacccuuaacaugaaucuggcuccacccguggccccuaacuuucccggagaacagcucuuguucuuuagauccuucgucccaugcagcggcgguuacaaccaggggauuaucgauugucugauuccucaagaguggauccagcauuuuuaucaggaaucggcacccucucaguccgacguggccuuaaucagguacguuaauccagauacaggccggacucuguucgaggcuaagcuacaccgaucaggauauauuaccguggcgcacaguggcgacuacccgcucguagucccugcaaacgggcauuuucgcuucgacagcugggugaaucaauucuauucccuggcccccuga

SEQ ID NO: 21723 - RNA, 1590 nt, Artificial Sequence
  derived and/or modified sequence opt3 from VP1__Norovirus_and/or_Norovirus-like__AB810009
augaagauggccagcaacgacgcugcacccuccaaugauggcgccgcgucucuggugccugaggcuaucaacgaaaccaugccacucgagccggucgccggggcaucaauugccgcucccguugcaggacagacaaauauaaucgacccuuggauuagaacuaacuucgugcaagccccaaauggugaauuuacgguaagucccaggaacagcccuggcgagauccuucugaauuuggaauuagggccagaucugaaccccuaccuagcucaccucucccggauguauaauggauacgccggcgguguggagguccaggugcugcuugcggggaacgcauucaccgccggaaaaauucuguuugcugccaucccuccaaauuucccgguugacaugauaucucccgcacagaucacaauguugccucaucucauuguggauguccgcacucuggagccaaucaugauuccccugccugacgugcgaaacguauuuuaucacuucaauaaccagccacaaccccguaugagacucguugcuauguuauacaccccgcugaggucgaauggcucaggcgaugacguguuuacagucagcugccgggugcuuacccgcccuacucccgauuucgaauuuaucuauuuggugccaccuagugucgaguccaagacaaaacccuucacccugccaauacuaacgauuucugaacucacuaacagcagauuucccaucccuauugagcagcuguacaccgccccaaacgagaauaacguugugcagugucagaaugggaggugcacacuugacggagaacugcaagguacuacccaguugcucuccucagcgguauguaguuaucggggccgcacaguggccaaccgaggggauaauugggaccagaaccuguuacagcugaccuacccgagcggagcaucuuacgaucccacggacgaggucccugcuccacucggcacucaagacuucuccgguauccuuuauggggugcugacacaggauaauguuucagaaggaaccggcgaggccaagaacgcuaaaggcguguacaucagcacuacaagugggaaguuuacccccaagauuggaucuauagguuugcauuccaucacggaaaauguccacccuaaccagcaaagcagauucaccccagugggcguagcccagaaugagaacacacccuuccagcaguggguucuaccgcauuaugcaggggcccuggcucucaauacuaaccuggcgccugcaguggccccaaccuuucccggagagcaacuucuguucuuuaggucgcgggucccuugcgugcagggcuugcguggucaggacgcuuucauugauugucuccugccccaggaaugggucaaucacuuuuaccaagaggccgcaccaucucaggccgacguggcuuuaauccgcuauguuaacccugauacagggagaacucuguucgaagccaaacuacacagguccggcuuuauaaccgugucacauacaggagcauacccccucguagucccaccgaacggccacuuccgguuugacaguugggugaaucaguucuauagccuguga

SEQ ID NO: 21724 - RNA, 1590 nt, Artificial Sequence
  derived and/or modified sequence opt3 from VP1__Norovirus_and/or_Norovirus-like__KM461690
augaagauggccagcuccgacgcugcacccucuaacgauggcgccgcgaaucuggugccugaggcuaacaaugaagucauggcccucgagccaguugugggggcaucaaucgccgcuccgguagugggacagcaaaacauuauagaccccuggaucagagaaaauuucguccaggcaccucagggugaguuuaccgugaguccaaggaacagccccggcgaaaugcuucugaauuuggaguuagggccugagcugaacccauaccuaucccaccucucucggauguauaauggauacgccggcgguaugcagguucaagugguccuggcugggaacgccuucacagcgggaaaaauuaucuuugcagccgugcccccucauuucccaguagaaaauauuucggcugcccagaucacuaugugcccgcacguuauaguggauguccgccagcuugagcccgugcuguugccucucccagacauccgaaacagauuuuuccauuauaaucaggaaaacacgccccguaugaggcugguggcaaugcuguacaccccucuccgggcuaauucaggcgaggaugucuuuacaguuagcugucgcguguuaacuagaccagcccccgacuucgaguuuaccuuccugguaccgccuacaguggaaaguaagaccaaacccuuuacucuuccaauuuugacacugggcgagcuauccaacucuagguucccugcgcccaucgauaugcucuauaccgacccaaacgaagggauugucgugcaaccccagaauggacggugcacgcuggaugguacucuucagggcaccacacagcugguuccuacucaaaucugugccuuucgcgggaccuugauaggacagacaagccgauccucagacaguaccgauagcgcaccaagaaggcgggaccacccgcuccaugugcagcugaagaacuuagauggcacgcaauacgaccccacugacgaggucccugcugugcugggugccauugauuucaaagggacaguauucggaguugcuucucagcgugacguguccggccagcaggucggcgccacccgcgcacacgaagugcacaucaauacuacagauccaagauauacccccaagcucgggucaauucuuaugcauagcgagagugacgauuuugucacgggacaaccugugagguucaccccaaucgguaugggcgacaacgauuggcaccagugggagcugcccgacuacucugggcgguugacacuaaauaugaaccuggccccggcuguugcgccugcauuuccaggagaacgaauccucuucuuucgcuccauugugcccagcgccggcgguuacgggucgggccagauagauugccugaucccucaggaguggguacaacauuucuaucaggaagcugcccccucucaguccgcagucgcccuuauuagauacgugaauccagacacuggaaggaacaucuuugaggcuaagcugcaccgggaaggcuucauaaccguugccaauucagggaacaauccuauuguggugcccccaaacggauauuuucgcuucgaggcaugggucaauuga

SEQ ID NO: 21725 - RNA, 1587 nt, Artificial Sequence
  derived and/or modified sequence opt3 from VP1__Norovirus_and/or_Norovirus-like__JN400618
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucaucgaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccgcgguuugaaucucgcaccaaaccuuucagcgugcccguacucacuguggaggaaaugacaaauuccagauuuccaauuccuuuagagaagcuguucaccggacccucaagugcguuugucgugcagccacagaacgguagguguacgacugauggcguucuuuuggggaccacacaacugagccccgugaauaucugcacuuuccggggagacgucacccauauaccuggcucucgcaacuacacaaugaaucuagccucccagaacuggaacucauaugguccaaccgaggaaauuccggcaccccucgggacgccugauuucgugggaaaaauccagggcguacugacucagacaacccgaacuaauggcagcacaagagggcacaaggcuaccguuuacacgggaagugccgacuuuucuccaaaacuugguagggugcaauucgcuaccgauacagacaaugacuuugagacuaaccagaauaccaaguucacacccgucggcgugauucaggauggguccacuaccccucggaacgaaccacaacaguggguccugcccagcuacucgggacguaauauccauaacgugcacuuggccccggcaguugccccuacauuuccaggcgagcagcuccuguucuuucgcucuaccaugcccgguuguuccggguauccuaauauggacuuagauugccugcucccccaggaaugggugcaauacuucuaucaggaggcugcgccagcacagucagacguagcccuucugagauuugucaacccugauacuggcaggguguuguucgaguguaagcuacacaaaaguggauacguuacgguggcucauacaggccagcacgaccuggucauucccccaaacggguauuuucgguucgauagcugggugaaucaauuuuacacccucgccccgaugggaaacgguacuggccgacgcagauga

SEQ ID NO: 21726 - RNA, 1587 nt, Artificial Sequence
  derived and/or modified sequence opt3 from VP1__Norovirus_and/or_Norovirus-like__JQ653095
augaagauggccagcaacgacgcugcacccuccaaugauggcgccgcggggcuggugccugaggucaacaaugaaaccauggcucucgagccaguugccggagcaucuaucgccgcuccgcuuacaggucagaacaaugugauugaccccuggauaagacugaacuucguacaagcacacaauggcgaauuuacugugucaccuaggaacaguccaggggaggucuuguuaaaucuggaacuaggacccgagcucaacccuuaccuggcccaucuuagccggauguauaauggcuacgcuggugggguggagguucaggugcuguuggccggaaacgcguucacggcaggcaaacucgucuuugccgcugugccaccccacuucccucuggaaaauaucuccccaggccagauuaccauguuuccgcauguaaucauugauguucgcacacuggagcccgugcucuuaccucugccagacguccgaaacaauuucuuucacuauaaccagcaaaacgaaccccguaugagacuuguggccauguuguacacuccucugaggucuaaugggucgggagaugacguguucaccgucucaugccggguuccaacacgccccagcccggauuuugacuucaacuaucuagugccucccaccguagagaguaagacuaaaccauuuacacucccuauccugaccauaggugagcuuacuaauuccagauuccccgugccaaucgaugaacuguacacgucucccaacgagagcuuggucgugcagccucagaaugggaggugugcacucgacggcgaacugcagggaaccacacaauuacugccaacugcuauuugcuccuuucggggccgcaucaaccagaagguuucaggugagaaucauguguggaacaugcaggucaccaauauuaacgggacaccguucgaucccaccgaagacgugccugccccacucggaacgcccgauuucaguggcaaacuuuuuggcguacugagccagcgagaccacgacaaugcguguagaucucacgaugccguuaucgcaacuaacuccgcuaaguucacaccuaaguugggggccauacaaauuggaaccugggagcaggacgaugugcauaucaaucagccaacuaaauuuacacccgucggucuauucgagucagaaggcuuuaaccaauggacccugccgaauuauagcggggcucucacgccuaacaugggacuggccccacccguggcaccuaccuuccccggcgagcagauucuguuuuucaggagucacaucccacuuaaggguggggucgccgacccugugaucgauugcuugguuccccaggaauggauucagcaucucuaccaagagucugcuccaucccagacagacguggcgcugauacgguuuacuaacccggauaccggccguguauuauucgaagcaaaacugcaccgcagcggauacaucacagucgccaauacuggcucgagaccuauugugguucccgcuaacggguauuuuagguucgacucuugggugaaucaguuuuacucccuagccccagucggaaccgguuga

SEQ ID NO: 21727 - RNA, 1587 nt, Artificial Sequence
  derived and/or modified sequence opt3 from VP1__Norovirus_and/or_Norovirus-like__JN183161
augaugauggccagcaaggacgcucccuccaacauggauggcaccucuggggcaggacagcuggugccugaggucaaugccgcggaaccacucccgcuugagcccguugugggugcugccacagcagccgcuacugcaggccaaguaaaccugaucgacccuuggauuaugaauaacuucgugcaggccccagaaggggaguuuacgauaucacccaauaacaccccuggagauaucuuguucgacuuacaccugggcccacaucuaaaucccuuucuccagcaccugagucagauguacaacgguugggucgggaauaugagagugaggguuaugcuugcuggaaacgccuucacagcgggcaaaauuaucauuugcugugugccuccaggcuuugcaagccaaaauaucuccauagggcaggccacuauguucccgcaugucaucgcugaugugcggguacuggaacccauugagaucccuuuggacgauguucgcaacgugcucuuucacaccaaugagaaccgaccaacaaugcgucugcugugcaugcucuauacccccuuaagagccggaggugcaucuucgggcacugacccuuucgucauugcugggagggugcugacauguccagcccccgauuuuaauuuccuuuuucuugugccgccuucagucgaacagaagacccggcagcugacgguucccaacaucccacuaaacaauauggcgaacagccgcgugccugccaugauaaauaaaaugacuguaaguuccgaccaaaaccaggugguccaguuccagaauggaagaugcacccucgagggccaacugcuugguacaacucccgugucugcaagccagguugcuaggauucgggggaagguguuuuccaccgccucaggaaaaggccugaacuugacagaacucgauggcaccccauaccaugcuuucgagagucccgccccucugggguucccagacaucggagcaugugauuggcacgucagcacguuuaagguggaccagaauuuaucuggugacccgaugucccgccuggauauuaagcaaaacgcccccuucgcuccucaccucggcucaaucgaguuuacuagcgaccaggauccaacaggggaccagcuuggaacccuggcguggguaagucccucuacuuccggcacacgaguugauccuuggaaaaucccaagcuaugguucgaccgugacggaaucuacccauuuggcacccccgauuuucccuccaggguuuggcgaggccauagucuacuucauguccgacuuucccaucgugucaggaaauacagcucaggucccuugcacucuaccccaagaguucgugagucacuuuguugaacagcaggccccaauuagaggcgaagcagcccugcuccauuauguggauccugacacccacaggaaccugggggaguucaaguuguaccccgauggauuuaucacauguguaccaaauacugguggcgggccgcagaaccugccuaccaauggagucuucguguuuagcuccuggguuucucgguauuaccaauugaaacccgugggcacagcuuga

SEQ ID NO: 21728 - RNA, 1587 nt, Artificial Sequence
  derived and/or modified sequence opt3 from VP1__Norovirus_and/or_Norovirus-like__KT906670
augaagauggccagcaacgacgcugcacccuccaaugauggcgccgcggggcuggugccugagggaaacaaugaaacccucccacuugagccggucgcuggugccgcaaucgccgcucccguuacaggccagaacaauauuauagacccuuggaucagaacuaacuucgugcaagcaccaaauggggaauuuacgguaucucccaggaacucaccuggagagauucuguugaauuuagaacugggcccagaucuaaaccccuaccucgcccaccugagucggauguauaaugguuacgcugggggaguggagguccaggugcuucuggccggcaacgcguucaccgcaggcaaaaucuuguuugccgcuguuccuccaaauuucccgguggaguuucucagccccgcccagauuacaaugcugccucaucugaucgucgacgugcgcacucucgaaccaauaaugauccccuuaccugauguacgaaacaccuucuuucacuauuccaaucagccaaacucucguaugagacugguugcaaugcuuuacacacccuugaggucgaacgggucaggagacgauguguucaccgucagcugccgggugcugacucgcccgacaccugacuuugaguucaccuaucuagugcccccaagugucgaauccaagacgaaaccuuuuucucuccccauucugacucuuagcgagcugaccaauuccagauucccaguucccaucgauucauuguuuacagcucaaaacaaugugcuccagguacagugucagaacgguaggugcacucuggacggcgaguuacaagggaccacacagcugcucccuaguggaauuugugccuuccggggccgcgugaccgcgcagaucaaucagcgagauagauggcauaugcaacuucagaaccugaaugguacgacuuacgacccaacagaugacgucccggcccccuuggggaccccugacuucaagggagugguuuuuggcauggugagccagaggaacgucggcaaugaugcaccagggucuacucgggcucaacaggccuggguguccacauauucaccccaguucguaccuaaacuaggaagcguuaaccugcguauaagugacaaugaugacuuucaguuccaaccaaccaaguuuacgcccgugggugucaacgaugacgaugacggccacccguuccgccagugggaacucccuaauuacucuggggagcugacccuuaacaugaaucuggcuccacccguggccccuaacuuucccggagaacagcucuuguucuuuagauccuucgucccaugcagcggcgguuacaaccaggggauuaucgauugucugauuccucaagaguggauccagcauuuuuaucaggaaucggcacccucucaguccgacguggccuuaaucagguacguuaauccagauacaggccggacucuguucgaggcuaagcuacaccgaucaggauauauuaccguggcgcacaguggcgacuacccgcucguagucccugcaaacgggcauuuucgcuucgacagcugggugaaucaauucuauucccuggccuga

SEQ ID NO: 21729 - RNA, 1587 nt, Artificial Sequence
  derived and/or modified sequence opt3 from VP1__Norovirus_and/or_Norovirus-like__KT906671
augaagauggccagcaacgacgcugcacccuccaaugauggcgccgcggggcuggugccugagggaaacaaugaaacccucccacuugagccggucgcuggugccgcaaucgccgcucccguuacaggccagaacaauauuauagacccuuggaucagaacuaacuucgugcaagcaccaaauggggaauuuacgguaucucccaggaacucaccuggagagauucuguugaauuuagaacugggcccagaucuaaaccccuaccucgcccaccugagucggauguauaaugguuacgcugggggaguggagguccaggugcuucuggccggcaacgcguucaccgcaggcaaaaucuuguuugccgcuguuccuccaaauuucccgguggaguuucucagccccgcccagauuacaaugcugccucaucugaucgucgacgugcgcacucucgaaccaauaaugauccccuuaccugauguacgaaacaccuucuuucacuauuccaaucagccaaacucucguaugagacugguugcaaugcuuuacacacccuugaggucgaacgggucaggagacgauguguucaccgucagcugccgggugcugacucgcccgacaccugacuuugaguucaccuaucuagugcccccaagugucgaauccaagacgaaaccuuuuucucuccccauucugacucuuagcgagcugaccaauuccagauucccaguucccaucgauucauuguuuacagcucaaaacaaugugcuccagguacagugucagaacgguaggugcacucuggacggcgaguuacaagggaccacacagcugcucccuaccggaauuugugccuuccggggccgcgugacggcgcagaucaaucagcgagauagauggcauaugcaacuucagaaccugaaugguacuacauacgacccaaccgaugacgucccggcccccuuggggacuccugacuucaagggagugguuuuuggcauggugagucagaggaacgucggcaaugaugcaccagggagcacacgggcucaacaggccugggugucuaccuauucaccccaguucguaccuaaacuaggauccguuaaccugcguauaagcgacaaugaugacuuucaguuccaaccaacgaaguuuacccccgugggugucaacgaugacgaugacggccacccguuccgccagugggaacucccuaauuacaguggggagcugacacuuaacaugaaucuggcuccacccguggccccuaacuuucccggagaacagcucuuguucuuuagaucuuucgucccaugcuccggcgguuacaaccaggggauuaucgauugucugauuccucaagaguggauccagcauuuuuaucaggaaagcgcacccucgcagucugacguggccuuaaucagguacguuaauccagauacuggccggacccuguucgaggcuaagcuacaccgauccggauauauuacaguggcgcacucaggcgacuacccgcucguagucccugcaaacgggcauuuucgcuucgacaguugggugaaucaauucuauagccuggccuga

SEQ ID NO: 21730 - RNA, 1587 nt, Artificial Sequence
  derived and/or modified sequence opt3 from VP1__Norovirus_and/or_Norovirus-like__AB810013
augaagauggccagcaacgacgcugcacccuccaaugauggcgccgcgucucuggugccugaggcuaucaacgaaaccaugccacucgagccggucgccggggcaucaauugccgcucccguugcaggacagacaaauauaaucgacccuuggauuagaacuaacuucgugcaagccccaaauggugaauuuacgguaagucccaggaacagcccuggcgagauccuucugaauuuggaauuagggccagaucugaaccccuaccuagcucaccucucccggauguauaauggauacgccggcgguguggagguccaggugcugcuugcggggaacgcauucaccgccggaaaaauucuguuugcugccaucccuccaaauuucccgguugacaugauaucucccgcacagaucacaauguugccucaucucauuguggauguccgcacucuggagccaaucaugauuccccugccugacgugcgaaacguauuuuaucacuucaauaaccagccacaaccccguaugagacucguugcuauguuauacaccccgcugaggucgaauggcucaggcgaugacguguuuacagucagcugccgggugcuuacccgcccuacucccgauuucgaauuuaucuauuuggugccaccuagugucgaguccaagacaaaacccuucacccugccaauacuaacgauuucugaacucacuaacagcagauuucccaucccuauugagcagcuguacaccgccccaaacgagaauaacguugugcagugucagaaugggaggugcacacuugacggagaacugcaagguacuacccaguugcucuccucagcgguauguaguuaucggggccgcacaguggccaaccgaggggauaauugggaccagaaccuguuacagcugaccuacccgagcggagcaucuuacgaucccacggacgaggucccugcuccacucggcacucaagacuucuccgguauccuuuauggggugcugacacaggauaauguuucagaaggaaccggcgaggccaagaacgcuaaaggcguguacaucagcacuacaagugggaaguuuacccccaagauuggaucuauagguuugcauuccaucacggaaaauguccacccuaaccagcaaagcagauucaccccagugggcguagcccagaaugagaacacacccuuccagcaguggguucuaccgcauuaugcaggggcccuggcucucaauacuaaccuggcgccugcaguggccccaaccuuucccggagagcaacuucuguucuuuaggucgcgggucccuugcgugcagggcuugcguggucaggacgcuuucauugauugucuccugccccaggaaugggucaaucacuuuuaccaagaggccgcaccaucucaggccgacguggcuuuaauccgcuauguuaacccugauacagggagaacucuguucgaagccaaacuacacagguccggcuuuauaaccgugucacauacaggagcauacccccucguagucccaccgaacggccacuuccgguuugacaguugggugaaucaguucuauagcuga

SEQ ID NO: 21731 - RNA, 1584 nt, Artificial Sequence
  derived and/or modified sequence opt3 from VP1__Norovirus_and/or_Norovirus-like__EU096510
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacccaacaauuaaguugaucgcaaugcucuauacuccccugcgugcuaacaaugccggggaugacguguucaccgucucaugcagaguucugacaaggccgagcccugauuuugacuucauuuuucucgugcccccaaccguagaaagucggacuaaaccuuucacagugcccaucuuaaccgucgaggaaaugacgaacucccgcuuuccaauaccccuggagaaacuuuucacuggaccuucuggugcguucgugguucagccacagaauggcagauguaccacagaugggguguugcugggaacuacccaacuaagcccggucaacauuugcacauuuaggggcgacgugacccauaucgccgguacgcacaauuacacuaugaaccucgcaucccagaauuggaacaauuaugaucccacagaggaaauuccugcuccacuggggacccccgacuucguaggacggauccagggcaugcuuacucagacaacccgcggcgacgggucaacgcgaggacauaaggccaccguuaguacaggugaugugcacuuuacuccuaagcugggcagcauccaauucaacaccgacacaaauaacgauuuugagacugggcagaauaccaaguucacaccagucggagugguccaggacggcaacgguacccaccaaaaugaaccccagcaguggguguugccgucuuacuccgggagaacuggccauaacgcucaccucgccccugcaguugccccaacguuucccggagagcagcuguuauucuuuaggucaacaaugccuggcuguagcggguaccccaacaugaaucuggauugccuccuuccacaagaaugggugcagcauuucuaucaggaggcugcgccugcacagagugacguagcccuguugcgguuugucaaccccgauaccggacgugugcuauucgaguguaaacugcacaagucugguuacguuacuguggcucacaccggccaacaugaccucgucauuccaccgaauggguauuuucgcuucgauuccugggugaaccaguucuacacacuguga

SEQ ID NO: 21732 - RNA, 1584 nt, Artificial Sequence
  derived and/or modified sequence opt3 from VP1__Norovirus_and/or_Norovirus-like__EU096513
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcggugccuucgugguucagccucagaauggcagauguacuaccgacgggguguugcugggaacaacucaacuauccccagucaacauuugcaccuuuaggggcgaugugacacauaucgcagguucacggaauuacaccaugaaccucgcuagucugaauuggaacaauuaugacccgacggaagagauucccgccccucuugggacuccagauuucguaggaaagauccagggcguucugacacagaccacuaagggcgacgggagcacacgcggacacaaggcuaccguguacacggguucugcccccuuuaccccuaaauugggcuccguccaguucucaacagacacugaaaacgauuuugaggcacaucaaaauaccaaguucacaccagugggggucauccaggacggaagcacuacccaccgaaacgaaccccagcaaugggugcucccgaguuacucuggcagaaauguucacaacgugcaucuggccccugcuguagcgccaacauuucccggugagcaguuacuguucuuuagguccaccaugccuggguguagcggcuaucccaauauggaucucgacugccuucugccacaggaguggguccagcacuucuaccaagaagcagccccugcucagucggauguggccuugcuacgguuuguuaaccccgacacuggacgugugcuguucgaguguaaacuccauaagucuggcuaugucacgguggcacacacagggcagcacgaucugguaauuccaccgaacggauacuuucgcuucgacuccugggugaaucaguucuauacccuuuga

SEQ ID NO: 21733 - RNA, 1584 nt, Artificial Sequence
  derived and/or modified sequence opt3 from VP1__Norovirus_and/or_Norovirus-like__EU096514
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcggugccuucgugguucagccucagaauggcagauguacuaccgacgggguguugcugggaacaacucaacuauccccagucaacauuugcaccuuuaggggcgaugugacacauaucgcagguucacggaauuacaccaugaaccucgcuagucugaauuggaacaauuaugacccgacggaagagauucccgccccucuugggacuccagauuucguaggaaagauccagggcguucugacacagaccacuaagggcgacgggagcacacgcggacacaaggcuaccguguacacggguucugcccccuuuaccccuaaauugggcuccguccaguucucaacagacacugaaaacgauuuugagacccaucaaaauacaaaguucacuccagugggggucauccaggacggaggcaccacacaccgaaacgaaccccagcaaugggugcucccgagcuacagugguagaaauguucacaacgugcaucuggccccugcaguagcuccaaccuuucccggggagcaguuacuguucuuuaggucuacuaugccuggcuguuccggauaucccaauauggaucucgacugccuucugccacaggaguggguccagcacuucuaccaagaagcggccccugcacagagcgauguggcuuugcuacgguuuguuaaccccgacacgggccgugugcuguucgaguguaaacuccauaagucgggguaugucacaguggcccacaccggacagcacgaucugguaauuccaccgaacgguuacuuucgcuucgacucuugggugaaucaguucuauacucuuuga

SEQ ID NO: 21734 - RNA, 1584 nt, Artificial Sequence
  derived and/or modified sequence opt3 from VP1__Norovirus_and/or_Norovirus-like__EU096512
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcggugccuucgugguucagccucagaauggcagauguacuaccgacgggguguugcugggaacaacucaacuauccccagucaacauuugcaccuuuaggggcgaugugacacauaucgcagguucacggaauuacaccaugaaccucgcuagucugaauuggaacaauuaugacccgacggaagagauucccgccccucuugggacuccagauuucguaggaaagauccagggcguucugacacagaccacuaagggcgacgggagcacacgcggacacaaggcuaccguguacacggguucugcccccuuuaccccuaaauugggcuccguccaguucucaacagacacugaaaacgauuuugagacccaucaaaauacaaaguucacuccagugggggucauccaggacggaagcaccacacaccgaaacgaaccccagcaaugggugcucccgaguuacucuggcagaaauguucacaacgugcaucuggccccugcaguagcuccaaccuuucccggugagcaguuacuguucuuuagguccacuaugccuggguguagcggcuaucccaauauggaucucgacugccuucugccacaggaguggguccagcacuucuaccaagaagcggccccugcacagucggauguggcuuugcuacgguuuguuaaccccgacacgggacgugugcuguucgaguguaaacuccauaagucuggcuaugucacaguggcccacaccgggcagcacgaucugguaauuccaccgaacggauacuuucgcuucgacuccugggugaaucaguucuauacucuuuga

SEQ ID NO: 21735 - RNA, 1581 nt, Artificial Sequence
  derived and/or modified sequence opt3 from VP1__Norovirus_and/or_Norovirus-like__KU311161
augaugauggccagcaaggacgcucccuccaacauggauggcaccucuggggcaggacagcuggugccugaagucaaugccgcggaaccacucccgcuugagcccguugugggugcugccacagcagccgcuacugcaggccaaguaaacaugaucgacccuuggauuaugaauaacuucgugcaggccccagaaggggaguuuacgauaucacccaauaacaccccuggagauauccuguucgacuugagauuaggcccacaccugaaucccuuucuacuccaucugagucagauguacaacgguugggucgggaauaugagggugcggguuaugcuugcuggaaacgccuucagcgcgggcaaaauuaucauuugcugugugccuccaggcuuugaaucccagaauaucucuauagggcaagcaacaauguucccgcacgucaucgccgaugugcgcguacuggagcccauugagguuccuuuggacgaugugcgaaacguccucuuucauacuaaugaaaaccguccaaccaugagacugcugugcaugcucuauacacccuuaagggcuggaggugccucgucaggcaccgacccuuucgugaucgcagggcgggugcugacuuguccagcucccgauuuuaauuuccuuuucuuggucccgccuagcguugagcagaagacacgccagcugaccauucccaacaucccacuaaacaaucucgccaacaguagagugccugcgaugauaaauaaaaugacgguauccgccgaccagaaccaagugguccaguuccagaauggaaggugcacucuggaaggccagcuucuggguaccacacccgugucugcaaaccaaguugcucggauucgcgggaagguguuuagcacuaauuccggaaccggcuugaaccucacagaggucgauggcaccccauaccacgccuucgagucacccgcuccucugggguucccagacaucggaaauugugauuggcauguguaugccuuuaaaguaaaccagaauacgggugacccgauguaccgauuagacauuacucagggcaacaguuucgcaccccaccuggggagcaucgaauuuucuuccgagaaucacccuucaggagaucaacucggcacacuuaccuggaucagcccacugaacaaugccaguagaguugaccccuggaagauuccuacuuaugguucuacauugaccgaauccacgaaccuagcuccacccauauucccgccuggguuuggcgagagcaucguguacuucaugucggauuuuccaauugucucuggaaacaccgcgcagauccccugcacacugccucaggaauuuguguccucauuugucgagcagcaagcacccauaaggggcgaggccgcucuccugcauuauguggacccagauacucaccggaaucuuggggaguucaagcuguacccugacggauuuauuaccuguguucccaacacagguggcgggccacagaauuugccgaguaacggaguguucguauuuagcuccugggucucucguuacuaucagcucaaaccugugggcacuuga

SEQ ID NO: 21736 - RNA, 1581 nt, Artificial Sequence
  derived and/or modified sequence opt3 from VP1__Norovirus_and/or_Norovirus-like__KX907730
augaugauggccagcaaggacgcucccuccaacauggauggcaccucuggggcaggacagcuggugccugaagucaaugccgcggaaccacucccgcuugagcccguugugggugcugccacagcaguagccacugcuggccaagugaacaugaucgacccuuggauuaugaauaacuucguccaggcaccagaaggggaguuuacgauaucacccaauaacaccccuggagauauccuguucgacuugagauuaggcccacaccugaaucccuuucuacuccaucugagucagauguacaacgguuggguggggaauaugaggguucgggugaugcuugccggaaacgcuuucagcgccggcaaaauuaucauuugcugugucccuccaggcuuugaaucccagaauaucucuauagggcaagcgacaauguucccgcacgugaucgcagauguacgcguucuggagcccauugaggugccuuuggacgauguccgaaacgugcucuuucauacuaaugaaaaccguccaaccaugagacugcugugcaugcucuauacacccuuaagggccggaggugcuucgucaggcaccgacccuuucgugaucgccgggcggguccugacuuguccagcacccgauuuuaauuuccuuuucuugguuccgccuagcguggagcagaagacacgccagcugaccauucccaacaucccacuaaacaaucucgcuaacaguagaguaccugccaugauaaauaaaaugacgguguccgcggaccagaaccaagucgugcaguuccagaauggaaggugcacucuggaaggccagcuucuggguaccacacccguuucugccaaccaaguggcacggauucgcgggaaggucuuuagcacuaauuccggaaccggcuugaaccucacagagguggauggcaccccauaccacgcuuucgagucacccgccccucugggguucccagacaucggaaauugugauuggcauguauaugcuuuuaaaguuaaccagaauacgggugacccgauguaccgauuagacauuacucagggcaacaguuucgcaccccaccuggggagcaucgaauuuucuuccgagaaucacccuucaggagaucaacucggcacacuuaccuggaucagcccacugaacaaugccaguagaguggaccccuggaagauuccuacuuaugguucuacauugaccgaauccacgaaccuagccccacccauauucccgccuggguuuggcgaggcuaucgucuacuucaugagcgauuuuccaauugugucgggaaacaccgcgcagauccccugcacacugccucaggaauuugucucuuccuuuguggagcagcaagcacccauaaggggcgaggccgcucuccugcauuauguugacccagauacucaccggaaucuuggggaguucaagcuguacccugacggauuuauuaccugugugcccaacacagguggcgggccacagaauuugccgucaaacggaguauucgucuuuaguagcugggugucccguuacuaucagcucaaaccuguuggcacuuga

SEQ ID NO: 21737 - RNA, 1581 nt, Artificial Sequence
  derived and/or modified sequence opt3 from VP1__Norovirus_and/or_Norovirus-like__EU096507
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucaucgaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacucaacaauuaaguugaucgcaaugcucuauacuccacugcgugcuaacaaugccggggaugacguguucaccgucagcugcagaguucugacaaggcccaguccggauuuugacuucauuuuucucgugccucccaccguagaaucccggacuaaaccauucacagugccuaucuuaaccgucgaggaaaugucuaacagccgcuuucccgugccacuggagaaacuuuacacgggacccuccucagcguucguugugcagccucagaaugguagauguacuaccgauggcgucuugcuggggacaacucaacuaagugccgugaacauaugcaccuucaggggagacguaacacauauugcaggcagccacgauuauaccaugaaucucgcuucucagaacuggaauaacuacgacccaacggaggaaaucccggcuccccuggguacuccugacuuuguugggaagauucagggagugcuuacacagaccacucgggaggauggcuccacacgcgcccauaaggccaccgucucaacgggcagcgugcacuucaccccaaagcuggggaguguccaauacacaacugacaccaauaacgauuuucagacaggacagaauacuaaauucacccccguggguguuauccaagacggcucuaaccaccagaaugaaccucagcaguggguguugccaaacuauuccgggcgaacaggacauaauguacaccucgcacccgccgucgcuccgaccuuuccuggcgagcaacuguuauucuuuagaagcacuaugccagguuguucgggguaccccaacaugaaccuggauugccuccuuccucaggaaugggugcagcauuucuaucaggaggcggcacccgcccaaucugacguugcucuguugagguuugugaauccagauacgggccggguccuauucgaguguaagcugcacaaauccggauacgugacaguagcccacaccggcccucaugaccucgugauucccccaaacggguauuuucguuucgauucauggguuaaucaguuuuacacucuguga

SEQ ID NO: 21738 - RNA, 1581 nt, Artificial Sequence
  derived and/or modified sequence opt3 from VP1__Norovirus_and/or_Norovirus-like__AB810007
augaagauggccagcaacgacgcugcacccuccaaugauggcgccgcgucucuggugccugaggcuaucaacgaaaccaugccacucgagccggucgccggggcaucaauugccgcucccguugcaggacagacaaauauaaucgacccuuggauuagaacuaacuucgugcaagccccaaauggugaauuuacgguaagucccaggaacagcccuggcgagauccuucugaauuuggaauuagggccagaucugaaccccuaccuagcucaccucucccggauguauaauggauacgccggcgguguggagguccaggugcugcuugcggggaacgcauucaccgccggaaaaauucuguuugcugccaucccuccaaauuucccgguugacaugauaucucccgcacagaucacaauguugccucaucucauuguggauguccgcacucuggagccaaucaugauuccccugccugacgugcgaaacguauuuuaucacuucaauaaccagccacaaccccguaugagacucguugcuauguuauacaccccgcugaggucgaauggcucaggcgaugacguguuuacagucagcugccgggugcuuacccgcccuacucccgauuucgaauuuaucuauuuggugccaccuagugucgaguccaagacaaaacccuucacccugccaauacuaacgauuucugaacucacuaacagcagauuucccaucccuauugagcagcuguacaccgccccaaacgagaauaacguugugcagugucagaaugggaggugcacacuugacggagaacugcaagguacuacccaguugcucuccucagcgguauguaguuaucggggccgcacaguggccaaccgaggggauaauugggaccagaaccuguuacagcugaccuacccgagcggagcaucuuacgaucccacggacgaggucccugcuccacucggcacucaagacuucuccgguauccuuuauggggugcugacacaggauaauguuucagaaggaaccggcgaggccaagaacgcuaaaggcguguacaucagcacuacaagugggaaguuuacccccaagauuggaucuauagguuugcauuccaucacggaaaauguccacccuaaccagcaaagcagauucaccccagugggcguagcccagaaugagaacacacccuuccagcaguggguucuaccgcauuaugcaggggcccuggcucucaauacuaaccuggcgccugcaguggccccaaccuuucccggagagcaacuucuguucuuuaggucgcgggucccuugcgugcagggcuugcguggucaggacgcuuucauugauugucuccugccccaggaaugggucaaucacuuuuaccaagaggccgcaccaucucaggccgacguggcuuuaauccgcuauguuaacccugauacagggagaacucuguucgaagccaaacuacacagguccggcuuuauaaccgugucacauacaggagcauacccccucguagucccaccgaacggccacuuccgguuugacaguugggugaaucaguucuga

SEQ ID NO: 21739 - RNA, 1581 nt, Artificial Sequence
  derived and/or modified sequence opt3 from VP1__Norovirus_and/or_Norovirus-like__AB809989
augaagauggccagcaacgacgcugcacccuccaaugauggcgccgcgucucuggugccugaggcuaucaacgaaaccaugccacucgagccggucgccggggcaucaauugccgcucccguugcaggacagacaaauauaaucgacccuuggauuagaacuaacuucgugcaagccccaaauggugaauuuacgguaagucccaggaacagcccuggcgagauccuucugaauuuggaauuagggccagaucugaaccccuaccuagcucaccucucccggauguauaauggauacgccggcgguguggagguccaggugcugcuugcggggaacgcauucaccgccggaaaaauucuguuugcugccaucccuccaaauuucccgguugacaugauaucucccgcacagaucacaauguugccucaucucauuguggauguccgcacucuggagccaaucaugauuccccugccugacgugcgaaacguauuuuaucacuucaauaaccagccacaaccccguaugagacucguugcuauguuauacaccccgcugaggucgaauggcucaggcgaugacguguuuacagucagcugccgggugcuuacccgcccuacucccgauuucgaauuuaucuauuuggugccaccuagugucgaguccaagacaaaacccuucacccugccaauacuaacgauuucugaacucacuaacagcagauuucccaucccuauugagcagcuguacaccgccccaaacgagaauaacguugugcagugucagaaugggaggugcacacuugacggagaacugcaagguacuacccaguugcucuccucagcgguauguaguuaucggggccgcacaguggccaacagcggggauaauugggaccagaaccuguuacagcugaccuacccgucuggagcauccuacgaucccacggacgaggucccugcuccacucggcacucaagacuucucagguauccuuuauggggugcugacacaggauaauguuagcgaaggaaccggcgaggccaagaacgcuaaaggcguguacaucaguacuacaucugggaaguuuacccccaagauuggauccauagguuugcauagcaucacggaaaauguccacccuaaccagcaaucgcgauucaccccagugggcguagcccagaaugagaacacacccuuccagcaguggguucuaccgcauuaugcaggggcccuggcucucaauacuaaccuggcgccugcaguggccccaaccuuucccggagagcaacuucuguucuuuagaucuagggucccuugcgugcagggcuugcggggucaggacgcuuucauugauugucuccugccccaggaaugggucaaucacuuuuaccaagaggccgcaccaucccaggccgacguggcuuuaauccguuauguuaacccugauacagggcgcacucuguucgaagccaaacuacacagaucaggcuuuauaaccgugagucauacaggagcauacccccucguagucccaccgaacggccacuucagguuugacagcugggugaaucaguucuga

SEQ ID NO: 21740 - RNA, 1581 nt, Artificial Sequence
  derived and/or modified sequence opt3 from VP1__Norovirus_and/or_Norovirus-like__AB810000
augaagauggccagcaacgacgcugcacccuccaaugauggcgccgcgucucuggugccugaggcuaucaacgaaaccaugccacucgagccggucgccggggcaucaauugccgcucccguugcaggacagacaaauauaaucgacccuuggauuagaacuaacuucgugcaagccccaaauggugaauuuacgguaagucccaggaacagcccuggcgagauccuucugaauuuggaauuagggccagaucugaaccccuaccuagcucaccucucccggauguauaauggauacgccggcgguguggagguccaggugcugcuugcggggaacgcauucaccgccggaaaaauucuguuugcugccaucccuccaaauuucccgguugacaugauaucucccgcacagaucacaauguugccucaucucauuguggauguccgcacucuggagccaaucaugauuccccugccugacgugcgaaacguauuuuaucacuucaauaaccagccacaaccccguaugagacucguugcuauguuauacaccccgcugaggucgaauggcucaggcgaugacguguuuacagucagcugccgggugcuuacccgcccuacucccgauuucgaauuuaucuauuuggugccaccuagugucgaguccaagacaaaacccuucacccugccaauacuaacgauuucugaacucacuaacagcagauuucccaucccuauugagcagcuguacaccgccccaaacgagaauaacguugugcagugucagaaugggaggugcacacuugacggagaacugcaagguacuacccaguugcucuccucagcgguauguaguuaucggggccgcacaguggccaacagcggggauaauugggaccagaaccuguuacagcugaccuacccgucuggagcauccuacgaucccacggacgaggucccugcuccacucggcacucaagacuucucagguauccuuuauggggugcugacacaggauaauguuagcgaaggaaccggcgaggccaagaacgcuaaaggcguguacaucaguacuacaucugggaaguuuacccccaagauuggauccauagguuugcauagcaucacggaaaauguccacccuaaccagcaaucgcgauucaccccagugggcguagcccagaaugagaacacacccuuccagcaguggguucuaccgcauuaugcaggggcccuggcucucaauacuaaccuggcgccugcaguggccccaaccuuucccggagagcaacuucuguucuuuagaucuagggucccuugcgugcagggcuugcggggucaggacgcuuucauugauugucuccugccccaggaaugggucaaucacuuuuaccaagaggccgcaccaucccaggccgacguggcuuuaauccguuauguuaacccugauacagggcgcacucuguucgaagccaaacuacacagaucaggcuuuauaaccgugagucauacaggaguauacccccucgucgugccaccgaacggccacuucagguuugacagcuggguuaaucaguucuga

SEQ ID NO: 21741 - RNA, 1575 nt, Artificial Sequence
  derived and/or modified sequence opt3 from VP1__Norovirus_and/or_Norovirus-like__AB809999
augaagauggccagcaacgacgcugcacccuccaaugauggcgccgcgucucuggugccugaggcuaucaacgaaaccaugccacucgagccggucgccggggcaucaauugccgcucccguugcaggacagacaaauauaaucgacccuuggauuagaacuaacuucgugcaagccccaaauggugaauuuacgguaagucccaggaacagcccuggcgagauccuucugaauuuggaauuagggccagaucugaaccccuaccuagcucaccucucccggauguauaauggauacgccggcgguguggagguccaggugcugcuugcggggaacgcauucaccgccggaaaaauucuguuugcugccaucccuccaaauuucccgguugacaugauaucucccgcacagaucacaauguugccucaucucauuguggauguccgcacucuggagccaaucaugauuccccugccugacgugcgaaacguauuuuaucacuucaauaaccagccacaaccccguaugagacucguugcuauguuauacaccccgcugaggucgaauggcucaggcgaugacguguuuacagucagcugccgggugcuuacccgcccuacucccgauuucgaauuuaucuauuuggugccaccuagugucgaguccaagacaaaaucuuucacccugcccauacuaacgauuagcgaacucacuaacuccagauuuccaacccccaucgagcagcuguacacagccccuaacgagaauaacguugugcagugucagaaugggaggugcacucuugacggagaacugcaagguaccacacaguugcucucaagugcgguauguagcuaucggggccgcaccguggccaacucuggggauaauugggaccagaaccuguuacagcugacguacccauccggagcaucauacgauccgacugacgagguccccgcuccucucggcacacaagacuucagcgguauucuuuaugggggacugacccaggauaaugugagugaaggcacuggcgaggccaagaacgcuaaagggguuuacaucucuacaaccuccggaaaguuuacgccaaagaucgguagcauuggcuugcauucgauaaccgaaaaugugcaccccaaccagcaaucucgauucacaccugucgggguggcccagaaugagaacacuccauuccagcaguggguacuaccccauuaugcaggagcccuggcucucaauaccaaccuggcgccggcaguugccccuacauuuccaggcgagcaacuucuguucuuuagauccagggugcccugcguccaggguuugcgggggcaggacgcuuucaucgauugucuccugccucaggaaugggugaaucacuuuuaccaagaggccgcacccucacaggccgacgucgcuuuaauucguuaugugaacccagauacuggccgcacccuguucgaagccaaacuacacagaaguggauuuaucacaguuagccauaccggcgcauacccucucgugguacccccaaacgggcacuucagguuugacuccugggucaauuga

SEQ ID NO: 21742 - RNA, 1572 nt, Artificial Sequence
  derived and/or modified sequence opt3 from VP1__Norovirus_and/or_Norovirus-like__FJ692501
augaugauggccagcuccgacgcuacacccccuucugagggcgcaacaaaccuggugccagaagucaauacucagguugugccgcucgagcccguagccggggcggcugccgcagccccuuucacgggacaaaacaaugugaucgauccauggauuuuucagaacuucguccaggcuccccagggugaauuuaccgugucaccuagaaauacaccaggcgagauacuucugaggauccccuuggggccuaacuuaaauccauuccuggcacaccuaagucggauguacaacgccuggguuggaggcauggaagcugagaugauucucgccgguaaugcguuuacugcagggaagcugcuuaucguggcccugccgcccggauucgaggcuacccaauugaccccugcccaggcaaccgcuuuuccacaugucauugccgacgugcgcacucucgaacccaucccuauaccacugcccgauauccgaaacguacuguuccacuauaauggcgacccgacaccuaccauucagaucguugugaugcucuacacgcccuuacguacuaacggcaauggggaugacgucuuuaccgugagcggaagacugcuuacaaggccagcgccugauuucuccuuuucuuucuuggugcccccaacugucgagcagaaaacccggcccuuuacacugccuaaccuagccguuucggaccucucaaauagccgcuucccagcaccggugaacauucugagagcugaucccaacaccacgcuugcccuggacuaucaaaaugguaggugcacuuuggauggcgcucuccaggggacaaccccuacuaacaguuccuuccugggauacuuacggggcacaguagaccgcgucaauucugaucaggugcaugugcaucugcgagaaccaaacggugaccccuuucagcucgggcuuccuggaccacaaggcguucccgacuauagagccacccuggauaucuacguggacugggagaauaagaaccacggcaauccgugugaggggacguugaacaccggaagccagacagaauauacuccuggucuaggcacccugacauucaauaaaacuuccggggauaccccagagcagggagaccccgucauaaugaggcucguggcauuucggucaaaccugacagaucaacuuccugccuacaauggcgcuuucggucagggggaaaaccuggcgcccccaguaaguccucccguuccaggcgagguguuuuugcaguucggaagccguuacacccgccucggcgaaagagagcuggcaguccagugcuuacugccgucugaguggauuacucacuuuuauuccgaagccgcuccuauccaaggggaggccaugcuacucagguacgugcagcccgaccugggacggauucuuuucgaagcaaaguuguauaaagaggguuuugucacgguggccggcgggacaaauccaguuaccuuccccaucgauggaacuuuuguggcuguaucaugggucagccgaaacuucgugcugaguccuaugggcucuggucaggggcgcagaagguga

SEQ ID NO: 21743 - RNA, 1572 nt, Artificial Sequence
  derived and/or modified sequence opt3 from VP1__Norovirus_and/or_Norovirus-like__FJ692500
augaugauggccagcuccgacgcuacacccccuucugagggcgcaacaaaccuggugccagaagucaauacucagguugugccgcucgagcccguagccggggcggcugccgcagccccuuucacgggacaaaacaaugugaucgauccauggauuuuucagaacuucguccaggcuccccagggugaauuuaccgugucaccuagaaauacaccaggcgagauacuucugaggauccccuuggggccuaacuuaaauccauuccuggcacaccuaagucggauguacaacgccuggguuggaggcauggaagcugagaugauucucgccgguaaugcguuuacugcagggaagcugcuuaucguggcccugccgcccggauucgaggcuacccaauugaccccugcccaggcaaccgcuuuuccacaugucauugccgacgugcgcacucucgaacccaucccuauaccacugcccgauauccgaaacguacuguuccacuauaauggcgacccgacaccuaccauucagaucguugugaugcucuacacgcccuuacguacuaacggcaauggggaugacgucuuuaccgugagcggaagacugcuuacaaggccagcgccugauuucuccuuuucuuucuuggugcccccaacugucgagcagaaaacccggucguuuacacugcccaaccuagccguuucagaccucagcaauagucgcuucccugcaccagugaacauucugagagcugauccgaacaccacgcuugcccuggacuaucaaaaugguaggugcacuuuggauggcgcucuccaggggacaacccccacuaacuccucuuuccugggauacuuacggggcacaguagaccgcgugaauagcgaucagguccaugugcaucugcgagaaccuaacggugacccauuucagcucgggcuucccggaccucaaggcguuccagacuauagagccacccuggauaucuacguggacugggagaauaagaaccacggcaaucccugugaggggacguugaacaccggaucccagacagaauauacuccgggucuaggcacccugacauucaauaaaacuucaggggauaccccugagcagggagacccagucauaaugaggcucguggcauuucggaguaaccugacagaucaacuucccgccuacaauggcgcuuucggucagggggaaaaccuggcgccucccguaagcccaccuguucccggcgagguguuuuugcaguucggaucucguuacacccgccucggcgaaagagagcuggcaguccagugcuuacugccauccgaguggauuacucacuuuuauucagaagccgcuccgauccaaggggaggccaugcuacucagguacgugcagccugaccugggacggauucuuuucgaagcaaaguuguauaaagaggguuuugucacgguggccggcgggacaaaucccguuaccuucccaaucgauggaacuuuuguggcuguaagcugggucagucgaaacuucgugcugucucccaugggcuccggucaggggcgcagaagguga

SEQ ID NO: 21744 - RNA, 1572 nt, Artificial Sequence
  derived and/or modified sequence opt3 from VP1__Norovirus_and/or_Norovirus-like__AB031013
augaugauggccagcaaggacgcuaccuccucuguggauggcgcaucaggggccggacagcugguccccgagguuaacgcgagugacccucucgcuauggauccaguggccgguagcuccacagcaguagccacugcuggccaagugaauccgaucgaccccuggauuauaaacaauuucguccaggcaccucagggggaauuuacgaucucuccaaacaauacccccggaggcgugcuuuucgaucugucguuggguccucacuuaaacccauuucugcuacaucucucacagauguacaauggguggguuggaaacaugagagugaggauuaugcuggccggcaaugcuuucacagccggcaaaaucauugucagcugcauacccccuggguuuggaagucacaaccuuacuaucgcgcaagcaacccuguucccacaugugaucgccgacguacggacauuggauccgauugagguuccccucgaagacgugcgcaauguccuguuucacaacaaugaucgaaaccagcagaccaugcgucugguguguaugcucuauacuccuuuaagaacagguggcgggaccggagacuccuucguggucgcuggcaggguuaugacgugcccaucucccgauuuuaauuuccuguuucuugugccuccaacuguagagcagaagacccggcccuucacauugccgaaccugccucuaagcucccucucaaacagucgcgcaccccugccaaucagcgguauggggauuucuccugacaaugugcaauccguccaguuucagaacggaagauguacucuugauggcaggcuggugggcaccacacccguuucauugagccauguggccaaaauccgggggaccaguaauggaacggucauaaaccucacugaacuggacgguacaccauuccaccccuucgagggcccugcuccaauuggguuuccggacuuaggaggcugcgauuggcacaucaauaugacccaguucggucauucuucccaaacucaguacgacguggauacaacccccgacacguuuguaccucaccuggggagcauucaggccaacggcaucggaucgggcaauuauaucgggguucucucuuggguguccccacccucacauccuaguggaagccaagucgaucuuuggaagauuccaaacuacgguuccucuauaaccgaggcgacacaccuggcccccagcguguauccgccuggcuucggggaagucuugguguuuuucaugucaaaaaucccaggacccggcgcauacagucuaccuugucugcucccccaggaguauauuucccaccuggcuagcgaacaggccccaacuguuggugaggcugcccuucugcauuacguggacccugauaccgggcgcacauugggcgaguuuaaggcauaccccgacggauuccucacuugcguaccaaauggcgccucuucagggccgcagcaacugccuaucaacggagucuuuguguucguuaguugggugagccgauuuuaucaguuaaagcccgucgguaccgcuuccucugcgagauga

SEQ ID NO: 21745 - RNA, 1572 nt, Artificial Sequence
  derived and/or modified sequence opt3 from VP1__Norovirus_and/or_Norovirus-like__KU253442
augaugauggccagcaaggacgcuaccuccucuguggauggcgcaucaggggccggacagcugguccccgagguuaacgcgagugacccucucgcuauggauccaguggccgguagcuccacagcaguagccacugcuggccaagugaauccgaucgaccccuggauuauaaacaauuucguccaggcaccucagggggaauuuacgaucucuccaaacaauacccccggagaugugcuuuucgaccugucguugggcccucacuuaaacccauuucugcuacaucucucacagauguacaaugguuggguugggaacaugagagugaggauuaugcuggccggaaaugcuuucacagccggcaaaaucauugucagcugcauacccccuggcuuugggagucacaaccuuacuaucgcgcaagcaacccuguucccacaugugaucgccgauguacggacauuggacccgauugagguuccccucgaagaugugcgcaauguccuguuucacaacaaugaccgaaaccagcagaccaugcgucugguguguaugcucuauacuccuuuaagaacaggagguggcaccggggauuccucuguggucgcuggaaggguuaugacgugcccaagccccgacuucaauuuucuguuccuugugccuccaacuguagagcagaagacccggcccuuuacauugccgaaccugccucuauccucacucaguaacagccgcgcaccccugccaaucucuuccaugggcauuucaccugauaaugugcaaagcguccagcuucagaacgguagauguacucuggacgggagguuggugggaaccacacccguuagucucucucauguggccaaaauccggggcaccuccaauggcacggcuauaaaccugacugaauuagacgggacaccauuccaccccuuugagggaccugccccaauuggucugccggaucucggcgggugcgaccgccacaucaauaugacccaguucggacauagcucgcaaacucagcacgaugcggacacaacccccgauacgucugucccucaucuuggcuccauucaggccaacgguaucgggucaggcaauuacgugggaguacugaguuggaucagcccacccucccacccuucuggcagccaaguugacuuguggaagauuccaaacuaugggucaaguauaaccgaggcaacacaccuagcucccuccguguacccgccuggauucggugaaguccugguguuuuucaugagcaaaaugccaggccccggggccuauaaucucccuugucugcuuccccaggaguacaucucucaucuggcuucagaacaggccccaacugucggagaggcagccuugcuccacuauguggauccugacaccggccgaaaccugggugaguuuaaggcuuaccccgauggguucuuaacaugcguuccaaauggcgcgaguagcggaccgcagcaacugccuauuaacggcguguuuguauucgucuccugggugucuagauuuuaccagcuaaagcccguugggacugcaucgagcgccagguga

SEQ ID NO: 21746 - RNA, 1572 nt, Artificial Sequence
  derived and/or modified sequence opt3 from VP1__Norovirus_and/or_Norovirus-like__EF547392
augaugauggccagcaaggacgcuaccuccucuguggauggcgcaucaggggccggacagcugguccccgagguuaacgcgagugacccucucgcuauggauccaguggccgguagcuccacagcaguagccacugcuggccaagugaauccgaucgaccccuggauuauaaacaauuucguccaggcaccucagggggaauuuacgaucucuccaaacaauacccccggagaugugcuuuucgaccugucguugggcccucacuuaaacccauuucugcuacaucucucacagauguacaaugguuggguugggaacaugagagugaggauuaugcuggccggaaaugcuuucacagccggcaaaaucauugucagcugcauacccccuggcuuugggagucacaaccuuacuaucgcgcaagcaacccuguucccacaugugaucgccgauguacggacauuggacccgauugagguuccccucgaagaugugcgcaauguccuguuucacaacaaugaccgaaaccagcagaccaugcgucugguguguaugcucuauacuccuuuaagaacaggagguggcaccggggauuccuucguggucgcuggaaggguuaugacgugcccaucucccgacuuuaauuuccuguuucuugugccuccaacuguagagcagaagacccggcccuucacauugccgaaccugccucuaagcucccucucaaacagucgcgcaccccugccaaucagcggcauggguauuucuccugauaaugugcaauccguccaguuucagaacgggagauguacucuugacggaaggcuggugggcaccacacccguuucauugagccauguggccaaaauccggggcaccaguaaugggacggucauaaaccucacugaacuggacggaacaccauuccaccccuucgaggguccugcuccaauuggcuuuccggauuuagggggaugcgacuggcacaucaauaugacccaguucggccauucuucccaaacucaguacgauguggacacaacccccgauacguuuguaccucaccuggguagcauucaggccaacgggguuucgucuggcaauuauaucggagugcucuccugggucucaccacccagucauccuagcggcucccaaguggaccuuuggaagaucccaaacuacgggucuagcauuaccgaggcgacacaccuggcccccucagucuauccgccuggauucggugaaguguugguguuuuucaugaguaaaauaccaggccccggggcauacucccuaccuugucugcucccccaggaguauaucagccaccuggcuucugaacaggccccaacuguuggagaggcugcccuucugcauuacguagauccugacaccggccgcaauuugggugaguuuaaggcauaccccgauggguuccucacaugcgucccaaacggcgccucaaguggaccgcagcaacugccuauuaauggcguguuuguuuucgugagcugggucucccgauuuuaucaguuaaagcccguggggacugcuucuaccgcgagauga

SEQ ID NO: 21747 - RNA, 1572 nt, Artificial Sequence
  derived and/or modified sequence opt3 from VP1__Norovirus_and/or_Norovirus-like__KT943503
augaugauggccagcaaggacgcuaccuccucuguggauggcgcaucaggggccggacagcugguccccgagguuaacgcgagugacccucucgcuauggauccaguggccgguagcuccacagcaguagccacugcuggccaagugaauccgaucgaccccuggauuauaaacaauuucguccaggcaccucagggggaauuuacgaucucuccaaacaauacccccggagaugugcuuuucgaccugucguugggcccucacuuaaacccauuucugcuacaucucucacagauguacaaugguuggguugggaacaugagagugaggauuaugcuggccggaaaugcuuucacagccggcaaaaucauugucagcugcauacccccuggcuuugggagucacaaccuuacuaucgcgcaagcaacccuguucccacaugugaucgccgauguacggacauuggacccgauugagguuccccucgaagaugugcgcaauguccuguuucacaacaaugaccgaaaccagcagaccaugcgucugguguguaugcucuauacuccuuuaagaacaggagguggcaccggggauuccuucguggucgcuggaaggguuaugacgugcccaucucccgacuuuaauuuccuguuucuugugccuccaacuguagagcagaagacccggcccuucacauugccgaaccugccucuaagcucccucucaaacagucgcgcaccccugccaaucagcucuaugggcauuuccccugauaaugugcaaucaguccaguuucagaacgguagauguacucuugacgggaggcuggugggaaccacacccguuagcuugagucauguggccaaaauccggggcaccucuaauggcacggucauaaaccucacugaacuggacgggacaccauuccaccccuucgagggaccugcuccaauugguuuuccggauuuaggcgggugcgacuggcacaucaauaugacccaguucggacauuccagccaaacucaguacgauguggacacaacccccgauacguuuguaccucaccugggcucgauucaggccaacgguaucgggucuggcaauuauguuggagugcucuccuggaucucaccacccagucauccuagcggcucccaagucgaccuuuggaagauuccaaacuacgggucuagcauaaccgaggcgacacaccuggcccccucaguguauccgccuggauucggugaagucuugguguuuuucaugaguaaaaugccaggccccggggcauacaaucuaccuugucugcucccccaggaguauaucucccaccuggcuagcgaacaggccccaacuguuggagaggcugcccuucugcauuacguggauccugacaccggccgcaacuugggugaguuuaaggcauaccccgauggguuccucacaugcguaccaaauggcgccucuucaggaccgcagcaacugccuauuaacggcgucuuuguguucguuaguugggugagccgauuuuaucaguuaaagcccgucgggacugcuuccucugcgagauga

SEQ ID NO: 21748 - RNA, 1572 nt, Artificial Sequence
  derived and/or modified sequence opt3 from VP1__Norovirus_and/or_Norovirus-like__AY502016
augaugauggccagcaaggacgcuaccuccaacguggauggcgcaucuggggccggacagcugguccccgaagcgaauacaucagacccucucgcuauggauccaguugccgguaguagcacugcaguggccacggcuggccaaguaaacccgaucgaccccuggauuauaaauaacuucgugcaggcaccucagggggaauuuaccaucuccccaaauaacacacccggagauguccuuuucgaccugucuuugggcccucacuuaaauccauuucugcuacaucucucgcagauguacaacgguuggguggggaauaugagaguuaggauuaugcuggccggaaacgcuuucacugccggcaaaaucauugugucaugcauacccccuggcuuugggagccacaaucuuaccaucgcgcaaaguacacuguucccacaugucaucgcagaugugcggaccuuggacccgauugagguaccccucgaagauguucgcaacgugcuguuucacaauaacgaccgaaaucagcagacuaugcgucuggucuguaugcucuauacaccuuuaagaaccggagguggcacgggggauuccuucgugguggccggaagggucaugacuugcccaucucccgacuuuaacuuccuguuucuuguuccuccaaccguggagcagaagacacggcccuucacuuugccgaaccugccucuaagcucccucucaaauagucgcgcuccccugccaaucagcucuaugggcauuuccccugauaacguacaaucagugcaguuucagaaugguagauguacccuugacgggaggcuggucggaacaacccccgugagcuugagucagguugccaaaauccggggcacgucuaacggcacugugauaaaucucacagaacuggacgggaccccauuccaucccuucgagggaccugcaccaauugguuuuccggauuuaggcgggugcgacuggcacgucaacaugacucaauucggacacuccagccagacacaguuugauguggacaccacgcccgagaccuucguaccucaucugggcucgauccaagcuaaugguguugggucuggcaacuacauuggagugcucuccuggaucucaccacccagucacccuagcggcucccaggucgaucuuuggaagaucccaaauuaugggucuagcauuacagaagccacucaucuggcgcccucaguguuuccgccuggauucggugaggucuugguguuuuucaugaguaaaauaccaggccccggggccuacaaccuaccuugucugcucccccaggaauauaucucccacuuugcaagcgagcaggcuccaaccguuggagaggccgcucugcuucacuacguggacccugauacaggccgcaaucugggugaguucaaggccuaucccgacggguuuuugacuugcguaccaaacggcgcaucuucaggaccgcaacagcucccuauuaauggcgucuucguguuuguuaguugggugagccgauucuaccagcugaagcccgucgggaccgccuccucugcuagauga

SEQ ID NO: 21749 - RNA, 1572 nt, Artificial Sequence
  derived and/or modified sequence opt3 from VP1__Norovirus_and/or_Norovirus-like__KU253446
augaugauggccagcaaggacgcuaccuccucuguggauggcgcaucaggggccggacagcugguccccgagguuaacgcgagugacccucucgcuauggauccaguggccgguagcuccacagcaguagccacugcuggccaagugaauccgaucgaccccuggauuauaaacaauuucguccaggcaccucagggggaauuuacgaucucuccaaacaauacccccggagaugugcuuuucgaccugucguugggcccucacuuaaacccauuucugcuacaucucucacagauguacaaugguuggguugggaacaugagagugaggauuaugcuggccggaaaugcuuucacagccggcaaaaucauugucagcugcauacccccuggcuuugggagucacaaccuuacuaucgcgcaagcaacccuguucccacaugugaucgccgauguacggacauuggacccgauugagguuccccucgaagaugugcgcaauguccuguuucacaacaaugaccgaaaccagcagaccaugcgucugguguguaugcucuauacuccuuuaagaacaggagguggcaccggggauuccuucguggucgcuggaaggguuaugacgugcccaucucccgacuuuaauuuccuguuucuugugccuccaacuguagagcagaagacccggcccuucacauugccgaaccugccucuaagcucccucucaaacagucgcgcaccccugccaaucagcucuaugggcauuuccccugauaaugugcaaucaguccaguuucagaacgguagauguacucuugacgggaggcuggugggaaccacacccguuagcuugagucauguggccaaaauccggggcaccucuaauggcacggucauaaaccucacugaacuggacgggacaccauuccaccccuucgagggaccugcuccaauugguuuuccggauuuaggcgggugcgacuggcacaucaauaugacccaguucggacauuccagccaaacucaguacgauguggacacaacccccgauacguuuguaccucaccugggcucgauucaggccaacgguaucgggucuggcaauuauguuggagugcucuccuggaucucaccacccagucauccuagcggcucccaagucgaccuuuggaagauuccaaacuacgggucuagcauaaccgaggcgacacaccuggcccccucaguguauccgccuggauucggugaagucuugguguuuuucaugaguaaaaugccaggccccggggcauacaaucuaccuugucugcucccccaggaguauaucucccaccuggcuagcgaacaggccccaacuguuggagaggcugcccuucugcauuacguggauccugacaccggccgcaacuugggugaguuuaaggcauaccccgauggguuccucacaugcguaccaaauggcgccucuucaggaccgcagcaacugccuauuaucggcgucuuuguguucguuaguugggugagccgauuuuaucaguuaaagcccgucgggacugcuuccucugcgagauga

SEQ ID NO: 21750 - RNA, 1572 nt, Artificial Sequence
  derived and/or modified sequence opt3 from VP1__Norovirus_and/or_Norovirus-like__KU253445
augaugauggccagcaaggacgcuaccuccucuguggauggcgcaucaggggccggacagcugguccccgagguuaacgcgagugacccucucgcuauggauccaguggccgguagcuccacagcaguagccacugcuggccaagugaauccgaucgaccccuggauuauaaacaauuucguccaggcaccucagggggaauuuacgaucucuccaaacaauacccccggagaugugcuuuucgaccugucguugggcccucacuuaaacccauuucugcuacaucucucacagauguacaaugguuggguugggaacaugagagugaggauuaugcuggccggaaaugcuuucacagccggcaaaaucauugucagcugcauacccccuggcuuugggagucacaaccuuacuaucgcgcaagcaacccuguucccacaugugaucgccgauguacggacauuggacccgauugagguuccccucgaagaugugcgcaauguccuguuucacaacaaugaccgaaaccagcagaccaugcgucugguguguaugcucuauacuccuuuaagaacaggagguggcaccggggauuccuucguggucgcuggaaggguuaugacgugcccaucucccgacuuuaauuuccuguuucuugugccuccaacuguagagcagaagacccggcccuucacauugccgaaccugccucuaagcucccucucaaacagucuggcaccccuuccaaucagcucuaugggcauuuccccugauaaugugcaaucaguccaguuucagaacggucgcuguacucuggacgggagauuggugggaaccacacccguuagccucagucauguggccaaaaucaggggcaccucuaauggcacggucauaaaccugacugaauuagacgggacaccauuccaccccuucgagggaccugcuccaauugguuuuccggaucugggcgggugcgacuggcacaucaauaugacccaguucggacauuccagccaaacucaguacgauguggacacaacccccgauacguuuguaccucaccucggcucgauucaggccaacgguaucgggucuggcaauuauguuggagugcuuuccuggaucucaccacccagucauccuagcggcucccaagucgaccuguggaagauuccaaacuacgggucuagcauaaccgaggcgacacacuuggcccccucaguguauccgccuggauucggugaaguccuaguguuuuucaugaguaaaaugccaggccccggggcauacaaucugccuugucuccugccccaggaguauaucucccaccuugcuagcgaacaggccccaacuguuggagaggcugcccuguugcauuacguggauccugacaccggccggaaccucggugaguuuaaggcauaccccgauggguuccugacaugcguaccaaauggcgccucuucaggaccgcagcaauuaccuauuaacggcgucuuuguguucguuaguugggugagccgcuuuuaucagcugaagcccgucgggacugcuuccucugcgcgauga

SEQ ID NO: 21751 - RNA, 1572 nt, Artificial Sequence
  derived and/or modified sequence opt3 from VP1__Norovirus_and/or_Norovirus-like__KF039735
augaugauggccagcaaggacgcuaccuccucuguggauggcgcaucaggggccggacagcugguccccgagguuaacgcgagugacccucucgcuauggauccaguggccgguagcuccacagcaguagccacuacgggccaagugaauccgaucgaccccuggauuauaaacaauuucguccaggcuccucagggggaauuuaccaucucuccaaacaauacacccggagaugugcuuuucgaccugucguugggcccucacuuaaacccauuucugcuacaucucucacagauguacaaugguuggguugggaacaugagagugaggauuaugcuggcaggaaaugccuucacugcuggcaaaaucauugucagcugcauacccccuggcuuugggagucacaaccuuaccaucgcccaagcgacacuguucccacaugugaucgcagauguacggaccuuggacccgauugagguuccccucgaagaugugcgcaauguccuguuucacaacaaugaccgaaaccagcagacuaugcgucugguguguaugcucuauacaccuuuaagaaccggagguggcacgggggauuccuucguggucgccggaaggguuaugacuugcccaucucccgacuuuaauuuccuguuucuugugccuccaaccguagagcagaagacacggcccuucacuuugccgaaccugccucuaagcucccucucaaacagucgcgcuccccugccaaucagcucuaugggcauuuccccugauaaugugcaaucaguccaguuucagaacgguagauguacccuugacgggaggcuggugggaacaacccccguuagcuugagucauguggccaaaauccggggcacgucuaauggcacugucauaaaccucacagaacuggacgggaccccauuccaccccuucgagggaccugcaccaauugguuuuccggauuuaggcgggugcgacuggcacaucaauaugacucaguucggacauuccagccaaacacaguacgauguggacaccacgcccgauaccuuuguaccucaccugggcucgauucaggcuaacgguaucgggucuggcaauuauguuggagugcucuccuggaucucaccacccagucauccuagcggcucccaagucgaccuuuggaagauuccaaacuacgggucuagcauaacagaggccacucaccuggcgcccucaguguauccgccuggauucggugaagucuugguguuuuucaugaguaaaaugccaggccccggggccuacaaucuaccuugucugcucccccaggaguauaucucccaccuggcaagcgaacaggcuccaaccguuggagaggccgcccuucugcauuacguggauccugacacaggccgcaacuugggugaguuuaaggcuuaccccgauggguuccucacuugcguaccaaauggcgcaucuucaggaccgcagcaacugccuauuaacggcgucuuuguguucguuaguugggugagccgauuuuaucaguuaaagcccgucgggaccgccuccucugcuagauga

SEQ ID NO: 21752 - RNA, 1572 nt, Artificial Sequence
  derived and/or modified sequence opt3 from VP1__Norovirus_and/or_Norovirus-like__KF039732
augaugauggccagcaaggacgcuaccuccucuguggauggcgcaucaggggccggacagcugguccccgagguuaacgcgagugacccucucgcuauggauccaguggccgguagcuccacagcaguagccacugcuggccaagugaauccgaucgaccccuggauuauaaacaauuucguccaggcaccucagggggaauuuacgaucucuccaaacaauacccccggagaugugcuuuucgaccugucguugggcccucacuuaaacccauuucugcuacaucucucacagauguacaaugguuggguugggaacaugagagugaggauuaugcuggccggaaaugcuuucacagccggcaaaaucauugucagcugcauacccccuggcuuugggagucacaaccuuacuaucgcgcaagcaacccuguucccacaugugaucgccgauguacggacauuggacccgauugagguuccccucgaagaugugcgcaauguccuguuucacaacaaugaccgaaaccagcagaccaugcgucugguguguaugcucuauacuccuuuaagaacaggagguggcaccggggauuccuucguggucgcuggaaggguuaugacgugcccaucucccgacuuuaauuuccuguuucuugugccuccaacuguagagcagaagacccggcccuucacauugccgaaccugccucuaagcucccucucaaacagucgcgcaccccugccaaucagcucuaugggcauuuccccugauaaugugcaaucaguccaguuucagaacgguagauguacucuugacgggaggcuggugggaaccacacccguuagcuugagucauguggccaaaauccggggcaccucuaauggcacggucauaaaccucacugaacuggacgggacaccauuccaccccuucgagggaccugcuccaauugguuuuccggauuuaggcgggugcgacuggcacaucaauaugacccaguucggacauuccagccaaacucaguacgauguggacacaacccccguaacguuuguuccucaccugggcucgauucaggccaacgguaucgggucuggcaauuaugugggaguccucuccuggaucucaccacccagucauccuagcggcucccaaguggaucuuuggaagauuccaaacuacgggucuagcauaaccgaggcgacacaccuggcccccucagucuauccgccuggauucggugaaguguugguguuuuucaugaguaaaaugccaggccccggggcauacaaucuaccuugucugcucccccaggaguauaucucccaccuggcuagcgaacaggccccaacuguuggagaggcugcccuucugcauuacguagacccugauaccggccgcaacuugggugaguuuaaggcauaccccgacggguuccucacaugcgucccaaauggcgccucuucaggaccgcagcaacugccuauuaacggcguguuuguuuucgugaguugggucagccgauuuuaucaguuaaagcccguggggacugcuuccucugcgagauga

SEQ ID NO: 21753 - RNA, 1572 nt, Artificial Sequence
  derived and/or modified sequence opt3 from VP1__Norovirus_and/or_Norovirus-like__KF039734
augaugauggccagcaaggacgcuaccuccucuguggauggcgcaucaggggccggacagcugguccccgagguuaacgcgagugacccucucgcuauggauccaguggccgguagcuccacagcaguagccacugcuggccaagugaauccgaucgaccccuggauuauaaacaauuucguccaggcaccucagggggaauuuacgaucucuccaaacaauacccccggagaugugcuuuucgaccugucguugggcccucacuuaaacccauuucugcuacaucucucacagauguacaaugguuggguugggaacaugagagugaggauuaugcuggccggaaaugcuuucacagccggcaaaaucauugucagcugcauacccccuggcuuugggagucacaaccuuacuaucgcgcaagcaacccuguucccacaugugaucgccgauguacggacauuggacccgauugagguuccccucgaagaugugcgcaauguccuguuucacaacaaugaccgaaaccagcagaccaugcgucugguguguaugcucuauacuccuuuaagaacaggagguggcaccggggauuccuucguggucgcuggaaggguuaugacgugcccaucucccgacuuuaauuuccuguuucuugugccuccaacuguagagcagaagacccggcccuucacauugccgaaccugccucuaagcucccucucaaacagucgcgcaccccugccaaucagcucuaugggcauuuccccugauaaugugcaaucaguccaguuucagaacgguagauguacucuugacgggaggcuggugggaaccacacccguuagcuugagucauguggccaaaauccggggcaccucuaauggcacggucauaaaccucacugaacuggacgggacaccauuccaccccuucgagggaccugcuccaauugguuuuccggauuuaggcgggugcgacuggcacaucaauaugacccaguucggacauuccagccaaacucaguacgauguggacacaacccccgauacguuuguaccucaccugggcucgauucaggccaacgguaucgggucuggcaauuauguuggagugcucuccuggaucucaccacccagucgcccuagcggcucccaagucgaccuuuggaagauuccaaacuacgggucuagcauaaccgaggcgacacaucuggcccccucaguguauccgccuggauucggugaagucuugguguuuuucaugaguaaaaugccaggccccggggcauacaaucuaccuugucugcucccccaggaguauaucucccaccuggcuagcgaacaggccccaacuguuggagaggcugcccuucugcacuacguggauccugacaccggccgaaacuugggugaguuuaaggcauaccccgauggguuccucacaugcguaccaaauggcgccucuucaggaccgcagcaacugccuauuaacggcgucuuuguguucguuaguugggugagcagauuuuaucaguuaaagcccgucgggacugcuuccucugcgagguga

SEQ ID NO: 21754 - RNA, 1572 nt, Artificial Sequence
  derived and/or modified sequence opt3 from VP1__Norovirus_and/or_Norovirus-like__KF039729
augaugauggccagcaaggacgcuaccuccucuguggauggcgcaucaggggccggacagcugguccccgagguuaacgcgagugacccucucgcuauggauccaguggccgguagcuccacagcaguagccacugcuggccaagugaauccgaucgaccccuggauuauaaacaauuucguccaggcaccucagggggaauuuacgaucucuccaaacaauacccccggagaugugcuuuucgaccugucguugggcccucacuuaaacccauuucugcuacaucucucacagauguacaaugguuggguugggaacaugagagugaggauuaugcuggccggaaaugcuuucacagccggcaaaaucauugucagcugcauacccccuggcuuugggagucacaaccuuacuaucgcgcaagcaacccuguucccacaugugaucgccgauguacggacauuggacccgauugagguuccccucgaagaugugcgcaauguccuguuucacaacaaugaccgaaaccagcagaccaugcgucugguguguaugcucuauacuccuuuaagaacaggagguggcaccggggauuccuucguggucgcuggaaggguuaugacgugcccaucucccgacuuuaauuuccuguuucuugugccuccaacuguagagcagaagacccggcccuucacauugccgaaccugccucuaagcucccucucaaacagucgcgcaccccugccaaucagcucuaugggcauuuccccugauaaugugcaaucaguccaguuucagaacgguagauguacucuugacgggaggcuggugggaaccacacccguuagcuugagucauguggccaaaauccggggcaccucuaauggcacggucauaaaccucacugaacuggacgggacaccauuccaccccuucgagggaccugcuccaauugguuuuccggauuuaggcgggugcgacuggcacaucaauaugacccaguucggacauuccagccaaacucaguacgauguggacacaacccccgauacguuuguaccucaccugggcucgauucaggccaacgguguugggucuggcaauuaugugggaguccucuccuggaucucaccacccagucauccuagcggcucccaaguggaccuuuggaagaucccaaacuacgggucuagcauuaccgaggcgacacaccuggcccccucagucuauccgccuggauucggugaaguguugguguuuuucaugaguaaaaugccaggccccggggcauacaaucuaccuugucugcucccccaggaguauauaucccaccuggcuagcgaacaggccccaacuguuggagaggcugcccuucugcauuacguagauccugacaccggccgcaacuugggugaguuuaaggcauaccccgauggguuccucacaugcgucccaaauggcgccucuucaggaccgcagcaacugccuaucaacggcguguuuguuuucgugaguugggucagccgauuuuaucaguuaaagcccguggggacugcuuccucugcgagauga

SEQ ID NO: 21755 - RNA, 1572 nt, Artificial Sequence
  derived and/or modified sequence opt3 from VP1__Norovirus_and/or_Norovirus-like__KF039737
augaugauggccagcaaggacgcuaccuccucuguggauggcgcaucaggggccggacagcugguccccgagguuaacgcgagugacccucucgcuauggauccaguggccgguagcuccacagcaguagccacugcuggccaagugaauccgaucgaccccuggauuauaaacaauuucguccaggcaccucagggggaauuuacgaucucuccaaacaauacccccggagaugugcuuuucgaccugucguugggcccucacuuaaacccauuucugcuacaucucucacagauguacaaugguuggguugggaacaugagagugaggauuaugcuggccggaaaugcuuucacagccggcaaaaucauugucagcugcauacccccuggcuuugggagucacaaccuuacuaucgcgcaagcaacccuguucccacaugugaucgccgauguacggacauuggacccgauugagguuccccucgaagaugugcgcaauguccuguuucacaacaaugaccgaaaccagcagaccaugcgucugguguguaugcucuauacuccuuuaagaacaggagguggcaccggggauuccuucguggucgcuggaaggguuaugacgugcccaucucccgacuuuaauuuccuguuucuugugccuccaacuguagagcagaagacccggcccuucacauugccgaaccugccucuaagcucccucucaaacagucgcgcaccccugccaaucagcucuaugggcauuuccccugauaaugugcaaucaguccaguuucagaacgguagauguacucuugacgggaggcuggugggaaccacacccguuagcuugagucauguggccaaaauccggggcaccucuaauggcacggucauaaaccucacugaacuggacgggacaccauuccaccccuucgagggaccugcuccaauugguuuuccggauuuaggcgggugcgacuggcacaucaauaugacccaguucggacauuccagccaaacucaguacgaugugaacacaacccccgacacguuuguaccucaccugggcucgauucaggccaaugguaucgggucuggcaacuauguuggagugcucuccuggaucucaccacccagucauccuagcggcucccaagucgaucuuuggaagauuccaaauuacgggucuagcauaaccgaggcgacacaccuggcccccucaguguauccgccuggauucggugaagucuugguguuuuucaugaguaaaaugccaggccccggggcauacaaccuaccuugucugcucccccaggaguauaucucccaccuggcuagcgaacaggccccaacuguuggagaggcugcccuucugcauuacguggacccugauaccggccgcaauuugggugaguuuaaggcauaccccgacggguuccucacaugcguaccaaacggcgccucuucaggaccgcagcaacugccuauuaauggcgucuuuguguucguuaguugggugagccgauuuuaucaguuaaagcccgucgggacugcuuccucugcgagauga

SEQ ID NO: 21756 - RNA, 1572 nt, Artificial Sequence
  derived and/or modified sequence opt3 from VP1__Norovirus_and/or_Norovirus-like__KF039731
augaugauggccagcaaggacgcuaccuccucuguggauggcgcaucaggggccggacagcugguccccgagguuaacgcgagugacccucucgcuauggauccaguggccgguagcuccacagcaguagccacugcuggccaagugaauccgaucgaccccuggauuauaaacaauuucguccaggcaccucagggggaauuuacgaucucuccaaacaauacccccggagaugugcuuuucgaccugucguugggcccucacuuaaacccauuucugcuacaucucucacagauguacaaugguuggguugggaacaugagagugaggauuaugcuggccggaaaugcuuucacagccggcaaaaucauugucagcugcauacccccuggcuuugggagucacaaccuuacuaucgcgcaagcaacccuguucccacaugugaucgccgauguacggacauuggacccgauugagguuccccucgaagaugugcgcaauguccuguuucacaacaaugaccgaaaccagcagaccaugcgucugguguguaugcucuauacuccuuuaagaacaggagguggcaccggggauuccuucguggucgcuggaaggguuaugacgugcccaucucccgacuuuaauuuccuguuucuugugccuccaacuguagagcagaagacccggcccuucacauugccgaaccugccucuaagcucccucucaaacagucgcgcaccccugccaaucagcucuaugggcauuuccccugauaaugugcaaucaguccaguuucagaacgguagauguacucuugacgggaggcuggugggaaccacacccguuagcuugagucauguggccaaaauccggggcaccucuaauggcacggucauaaaccucacugaacuggacgggacaccauuccaccccuucgagggaccugcuccaauugguuuuccggauuuaggcgggugcgacuggcacaucaauaugacccaguucggacauuccagccaaacucaguacgauguggacacaacccccgauauuuuuguaccucaccugggcucgauccaggccaacgguaucgggucuggcaauuauguuggagugcucuccuggauuucaccacccagucauccuagcggcucccaagucgaccuuuggaagauaccaaacuacgggucuagcaucacggaggcgacccaccuggcccccucaguguauccgccuggauucggugaagucuugguguuuuucaugaguaaaaugccaggccccggggcauacaaucuaccuugucugcucccccaggaguauauuucccaccuggcuagcgaacaggccccaacaguuggagaggcugcccuucugcauuacguggauccugacacuggccgcaacuugggugaguuuaaggcauaccccgauggguuccugaccugcguaccaaauggcgccucuucaggaccgcagcaacucccuaucaacggcgucuuuguguucguuaguugggugagccgauuuuaucaguuaaagcccgucgggacagcuuccucugcgagauga

SEQ ID NO: 21757 - RNA, 1563 nt, Artificial Sequence
  derived and/or modified sequence opt3 from VP1__Norovirus_and/or_Norovirus-like__KT732279
augaugauggccagcaaggacgcuaccuccucuguggauggcgcaucaggggccggacagcugguccccgagguuaacgcgagugacccucucgcuauggauccaguggccgguagcuccacagcaguagccacugcuggccaagugaauccgaucgaccccuggauuauaaacaauuucguccaggcaccucagggggaauuuacgaucucuccaaacaauacccccggagaugugcuuuucgaccugucguugggcccucacuuaaacccauuucugcuacaucucucacagauguacaaugguuggguugggaacaugagagugaggauuaugcuggccggaaaugcuuucacagccggcaaaaucauugucagcugcauacccccuggcuuugggagucacaaccuuacuaucgcgcaagcaacccuguucccacaugugaucgccgauguacggacauuggacccgauugagguuccccucgaagaugugcgcaauguccuguuucacaacaaugaccgaaaccagcagaccaugcgucugguguguaugcucuauacuccuuuaagaacaggagguggcaccggggauucccugguggucgcuggaaggguuaugacgugcccaucucccgacuucaauuuucuuuucuuggugccuccaacuguagagcagaagacccggcccuuuacacugccgaaccuaccucucagcucccugucaaacagucgcgcaccccuuccaaucagcggcauggguauuucuccugauaaugugcaauccguccaguuccagaacgggagauguacucuggacggaagguuggugggcaccacacccguuucacucagccauguggccaaaauccggggcaccaguaaugggacggucauaaaccugacugaauuagacggaacaccauuucaccccuucgaggguccugcuccaauuggcuucccggaucucgggggaugcgacuggcacaucaauaugacccaguuuggccauucuucccaaacucaguacgauguggacacaacccccgauacguucguaccucaccuggguagcauucaggccaacgggaucaauucgggcaacuauaucggaguucuuucuuggguguccccacccucacauccuaguggcagccaagucgaccuguggaagauuccaaauuacggguccucuauaaccgaggcgacacacuuggcccccagcguguuuccgccuggauucggugaaguccuaguguuuuucaugucaaaaaucccaggccccggggcauauagucugccuugucuccugccccaggaguacauuucccaccuugcuagcgaacaggccccaacuguuggagaggcugcccuguugcauuauguggauccugacaccggccgcaaccucggugaguuuaaggcauaccccgauggguuccugacaugcguaccaaauggcgccucuucaggaccgcagcaauuaccuaucaacggcgucuuuguguucguuaguugggugagccgauuuuaccagcugaagcccgucgggacugcuuccuga

SEQ ID NO: 21758 - RNA, 1563 nt, Artificial Sequence
  derived and/or modified sequence opt3 from VP1__Norovirus_and/or_Norovirus-like__FJ384783
augaugauggccagcaaggacgcuaccuccucuguggauggcgcaucaggggccggacagcugguccccgagguuaacgcgagugacccucucgcuauggauccaguggccgguagcuccacagcaguagccacugcuggccaagugaauccgaucgaccccuggauuauaaacaauuucguccaggcaccucagggggaauuuacgaucucuccaaacaauacccccggagaugugcuuuucgaccugucguugggcccucacuuaaacccauuucugcuacaucucucacagauguacaaugguuggguugggaacaugagagugaggauuaugcuggccggaaaugcuuucacagccggcaaaaucauugucagcugcauacccccuggcuuugggagucacaaccuuacuaucgcgcaagcaacccuguucccacaugugaucgccgauguacggacauuggacccgauugagguuccccucgaagaugugcgcaauguccuguuucacaacaaugaccgaaaccagcagaccaugcgucugguguguaugcucuauacuccuuuaagaacaggagguggcaccggggauuccuucguggucgcuggaaggguuaugacgugcccaucucccgacuuuaauuuccuguuucuugugccuccaacuguagagcagaagacccggcccuucacauugccgaaccugccucuaagcucccucucaaacagucgcgcaccccugccaaucagcggcauggguauuucuccugauaaugugcaauccguccaguuucagaacgggagauguacucuugacggaaggcuggugggcaccacacccguuucauugagccauguggccaaaauccggggcaccaguaaugggacggucauaaaccucacugaacuggacggaacaccauuccaccccuucgaggguccugcuccaauuggcuuuccggauuuagggggaugcgacuggcacaucaauaugacccaguucggccauucuucccaaacucaguacgauguggacacaacccccgauacguuuguaccucaccuggguagcauucaggccaacgggaucaauucgggcaacuauaucggaguucucucuuggguguccccacccucacauccuaguggcagccaagucgaccuuuggaagauuccaaauuacggguccucuauaaccgaggcgacacaccuggcccccagcguguucccgccuggauuuggugaagucuugguguucuuuaugucaaaaaucccaggccccggggcauauagucuaccuugucugcucccccaggaguacauuucccaccuggcuagcgaacaggccccaacuguuggagaggcugcccuucugcauuauguggauccugacaccggccgcaacuugggugaguucaaggcauaccccgauggguuucucacaugcguaccaaauggcgccucuucaggaccgcagcaacugccuaucaacggcgucuucguguuuguuaguugggugagccgauucuaccaguuaaagcccgucgggacugcuuccuga

SEQ ID NO: 21759 - RNA, 1563 nt, Artificial Sequence
  derived and/or modified sequence opt3 from VP1__Norovirus_and/or_Norovirus-like__EU085522
augaugauggccagcaaggacgcuaccuccucuguggauggcgcaucaggggccggacagcugguccccgagguuaacgcgagugacccucucgcuauggauccaguggccgguagcuccacagcaguagccacugcuggccaagugaauccgaucgaccccuggauuauaaacaauuucguccaggcaccucagggggaauuuacgaucucuccaaacaauacccccggagaugugcuuuucgaccugucguugggcccucacuuaaacccauuucugcuacaucucucacagauguacaaugguuggguugggaacaugagagugaggauuaugcuggccggaaaugcuuucacagccggcaaaaucauugucagcugcauacccccuggcuuugggagucacaaccuuacuaucgcgcaagcaacccuguucccacaugugaucgccgauguacggacauuggacccgauugagguuccccucgaagaugugcgcaauguccuguuucacaacaaugaccgaaaccagcagaccaugcgucugguguguaugcucuauacuccuuuaagaacaggauccgguaccggcgauucuuucguggucgcugggaggguuaugacgugcccaagccccgacuuuaauuuccuguuucuugugccuccaacuguagagcagaagacccggcccuucacauugccgaaccugccucuauccucacucaguaacagccgcgcaccccugccaaucucuggaaugggcauuuccccugauaaugugcaaucaguccaguuucagaacgguagauguacucuugacgggaggcuggugggaaccacacccguuagcuugagucauguggccaaaauccggggcaccucuaauggcacggucauaaaccucacugaacuggacgggacaccauuccaccccuucgagggaccugcuccaauugguuuuccggauuuaggcgggugcgacuggcacaucaauaugacccaguucggacauuccagccaaacucaguacgauguggacacaacccccgauacguuuguaccucaccugggcucgauucaggccaacgguaucaauucugggaacuauaucggcguucucuccugggugucaccacccagucauccuagcggaucccaagucgaccuuuggaagauuccaaauuacggcucuagcauaaccgaggcgacacaccuggcccccucaguguucccgccuggguuuggagaagucuugguguucuuuaugaguaaaaucccaggucccggcgcauauucccuaccuugucugcucccccaggaguacauuagccaccuggcuucugaacaggccccaacuguuggggaggcugcccuucugcauuauguggauccugacaccggacgcaacuugggcgaguucaaggcauaccccgaugguuuucucacaugcguaccaaauggggccucaaguggcccgcagcaacugccuaucaacggagucuucguguuuguuagcugggugucccgauucuaccaguuaaagcccgucggcacugcuucuuga

SEQ ID NO: 21760 - RNA, 1563 nt, Artificial Sequence
  derived and/or modified sequence opt3 from VP1__Norovirus_and/or_Norovirus-like__L23828
augaugauggccagcaaggacgcuaccuccucuguggauggcgcaucagccaguguccagcugguucccgaggugaacgcgagcgacccucucgcuauggauccaguagccggguccucuacagcaguggccacugcuggacaagucaauccgaucgaccccuggauuauaaacaauuucgugcaggcaccucagggugaauuuacgaucucgccaaacaauacccccggcgauguucuuuucgaccugucauuggggccucacuuaaacccauuucugcuacaucucagccagauguacaauggaugggugggcaacaugagagucaggauuaugcuggccgguaaugcuuucacagccgggaaaaucauugugaguugcauacccccuggauuuggcucccaacagcuuacuaucgcgcaggcaacccuguucccacacguaaucgccgauguucggacauuggacccgauugaggugccccucgaagauguccgcaacgugcuguuucauaauaacgaccgaaaucagcaaaccaugcgucugguguguaugcucuauacuccuuuaucuacaggcgggggaaccggugauagcuucgucguugcuggcagagugaugacgugcccaucccccgacuuuaacuuccuguuucuuguaccuccaacuguggagcagaagaccaggcccuucacauugccgaaucugccucuaucaagucucagcaacucucgggcaccccugccaaucuccgggaugggaauuucaccugauaacguccagagcgugcaguuucaaaauggccgcuguacucuugacgguagacugguugggaccacacccgugaguuugucucacgucgccaaaaucaggggaaccuccaacggcacggugauaaaucucacugaacuggacggcacaccauuccaucccuucgaggggccugcuccaauuggauuuccggauuuagguggcugcgacuggcacaucaacaugacccaguucgggcacagcucgcagacucaauacgauguagacacaacccccgauacgucuguuccucaucugggauccauucaggccaauggcaucgguucagggaacuauaucggcgugcucaguugggucagcccacccucccacccuucuggaagccagguggaccuuuggaagauuccaaauuacggcucaaguauaaccgaggcgacacaucuggcccccuccgucuauagcccgggguuuggagaaguguugguuuucuuuaugucuaaaaucccugguccaggcggggauucacuacccugucugcucccucagggauacauuagucaccuggcaagcgagcaagcucccacugugggcgaagguccacuucugcacuauguagacccugauaccgaccggaacuugggggaguucaaggccuaccccgauggcuuucucacaugcgucccaaauggagcuuccucuggcccgcagcagcugccuaucaacgggguguucguuuuugugucgugggucagccgcuucuaccaguuaaagcccgugggaacugccuccuga

SEQ ID NO: 21761 - RNA, 1563 nt, Artificial Sequence
  derived and/or modified sequence opt3 from VP1__Norovirus_and/or_Norovirus-like__KX764843
augaagauggccagcaacgacgcugcacccuccaaugauggcgccgcggggcuggugccugagggaaacaaugaaacccucccacuugagccggucgcuggugccgcaaucgccgcucccguuacaggccagaacaauauuauagacccuuggaucagaacuaacuucgugcaagcaccaaauggggaauuuacgguaucucccaggaacucaccuggagaggugcuguugaauuuagaacugggcccagaucuaaaccccuaccucgcccaccugagucggauguauaaugguuacgcugggggagucgaggugcagguucuucuggccggcaacgcguucaccgcaggcaaaauuuuguuugccgcugugccuccaaauuucccggucgaguuucucagccccgcccagaucacaaugcugccucaucugauuguggacguacgcacucucgaaccaaucaugauacccuuaccugauguucgaaacaccuucuuucacuauuccaaucagccaaacucucguaugagacugguggcaaugcuuuacacacccuugaggucgaacgggucaggagacgaugucuucaccgugagcugccgggugcugacucgcccgacaccugacuuugaguucaccuaucuaguucccccaagugucgaauccaagacgaaaccuuuuucucuccccauccugacucuuagcgagcugaccaauuccagauucccagugcccauugauucauuguuuacagcucaaaacaauguacuccaggugcagugucagaacgguaggugcacucuggacggcgaguuacaagggaccacacagcugcucccuaguggaaucugugccuuccggggccgcgucaccgcgcagauuaaucagcgagauagauggcauaugcaacuucagaaccugaaugguacgacuuacgacccaacagaugacgugccggcccccuuggggaccccugacuucaagggaguuguguuuggcauggucagccagaggaacgugggcaaugaugcaccagggucuacucgggcucaacaggccuggguauccacauauucaccccaguucguuccuaaacuaggaagcgugaaccugcguaucagugacaaugaugacuuucaguuccaaccaaccaaguuuacgcccgucggugugaacgaugacgaugacggccacccguuccgccagugggaacucccuaauuacucuggggagcugacccuuaacaugaaucuggcuccacccgucgccccuaacuuucccggagaacagcucuuguucuuuagauccuucgugccaugcagcggcgguuacaaccaggggauaauugauugucugaucccucaagaguggauucagcauuuuuaucaggaaucggcacccucucaguccgacguugccuuaaucagguacgugaauccagauacaggccggacucuguucgaggcuaagcuacaccgaucaggauauaucaccguagcgcacaguggcgacuacccgcucgucgugccugcaaacgggcauuuucgcuucgacgccugguga

SEQ ID NO: 21762 - RNA, 1563 nt, Artificial Sequence
  derived and/or modified sequence opt3 from VP1__Norovirus_and/or_Norovirus-like__KX764841
augaagauggccagcaacgacgcugcacccuccaaugauggcgccgcggggcuggugccugagggaaacaaugaaacccucccacuugagccggucgcuggugccgcaaucgccgcucccguuacaggccagaacaauauuauagacccuuggaucagaacuaacuucgugcaagcaccaaauggggaauuuacgguaucucccaggaacucaccuggagagauucuguugaauuuagaacugggcccagaucuaaaccccuaccucgcccaccugagucggauguauaaugguuacgcugggggaguggagguccaggugcuucuggccggcaacgcguucaccgcaggcaaaaucuuguuugccgcuguuccuccaaauuucccgguggaguuucucagccccgcccagauuacaaugcugccucaucugaucgucgacgugcgcacucucgaaccaauaaugauccccuuaccugauguacgaaacaccuucuuucacuauuccaaucagccaaacucucguaugagacugguugcaaugcuuuacacacccuugaggucgaacgggucaggagacgauguguucaccgucagcugccgggugcugacucgcccgacaccugacuuugaguucaccuaucuagugcccccaagugucgaauccaagacgaaaccuuuuucucuccccauucugacucuuagcgagcugaccaauuccagauucccaguucccaucgauucauuguuuacagcucaaaacaaugugcuccagguacagugucagaacgguaggugcacucuggacggcgaguuacaagggaccacacagcugcucccuaguggaauuugugccuuccggggccgcgugaccgcgcagaucaaucagcgagauagauggaggaugcaacuucagaaccugaaugguacgacuuacgacccaacagaugacgucccggcccccuuggggaccccugacuucaagggagugguuuuuggcauggugagccagcggaacgucggcaaugaugcaccagggucuacucgugcucaacaggccuggguguccacauauucaccccaguucguaccuaaacuaggaagcguuaaccugcgcauaagugacaaugaugacuuucaguuccaaccaaccaaguuuacgcccgugggugucaacgaugacgaugacggccauccguucagacagugggaacucccuaauuacucuggggagcugacccuuaacaugaaucuggcuccacccguggccccuaacuuucccggagaacagcucuuguucuuuagguccuucgucccaugcagcggcgguuacaaccaggggauuaucgauugucugauuccucaagaguggauccagcacuuuuaucaggaaucggcacccucucaguccgacguggccuuaauccgguacguuaauccagauacaggccgaacucuguucgaggcuaagcuacaucgcucaggauauauuaccguggcgcacaguggcggguacccgcucguagucccugcaaacggacacuuuagauucgagagcugguga

SEQ ID NO: 21763 - RNA, 1563 nt, Artificial Sequence
  derived and/or modified sequence opt3 from VP1__Norovirus_and/or_Norovirus-like__KX764840
augaagauggccagcuccgacgcugcacccucuaacgauggcgccgcggggcuggugccugagggaaauaacgaaacccucccacuugagccggucgcuggugccgcaaucgccgcucccguuacaggccagaauaacauuauagacccuuggaucagaacuaauuucgugcaagcaccaaacggggaauuuacgguaucacccaggaauaguccuggagagauucuguugaacuuagaacugggcccagaucuaaaucccuaccucgcccaccugagccggauguauaacgguuacgcugggggaguggagguccaggugcuucuggccggcaaugcguucaccgcaggcaaaaucuuguuugccgcuguuccuccaaacuucccgguggaguuucucucccccgcccagauuacaaugcugccucaucugaucgucgacgugcgcacucucgaaccaauaaugauccccuuaccugauguacgaaauaccuucuuucacuauucuaaccagccaaauucgcguaugagacugguugcaaugcuuuacacacccuugaggucaaacgggagcggagacgauguguucaccgucaguugccgggugcugacucgcccgacaccugacuuugaguucaccuaucuagugcccccauccgucgaaucuaagacgaaaccuuuuagccuccccauucugacucuuuccgagcugaccaacucaagauucccaguucccaucgauaguuuguuuacagcucaaaauaacgugcuccagguacagugucagaaugguaggugcacucuggacggcgaguuacaagggaccacacagcugcucccuagcggaauuugugccuuccggggccgcgugaccgcgcagaucaaccagcgagauagauggcauaugcaacuucagaaucugaacgguacgacuuacgacccaacagaugacgucccggcccccuuggggaccccugacuucaagggagugguuuuuggcauggugucucagaggaaugucggcaacgaugcaccaggguccacucgggcucaacaggccugggugucaacauauagcccccaguucguaccuaaacuaggaaguguuaaucugcguauaucugacaacgaugacuuucaguuccaaccaaccaaguuuacgcccgugggugucaaugaugacgaugacggccacccguuccgccagugggaacucccuaacuacuccggggagcugacccuuaauaugaaccuggcuccacccguggccccuaauuuucccggagaacagcucuuguucuuuaggagcuucgucccaugcucgggcgguuacaaccaggggauuaucgauugucugauuccucaagaguggauccagcauuuuuaucaggaaucugcacccucccagucagacguggccuuaaucagauacguuaacccagauacaggccggacucuguucgaggcuaagcuacaccgaaguggauauauuaccguggcgcacagcggcgacuacccgcucguagucccugcaaaugggcauuuucgcuucgacuccugguga

SEQ ID NO: 21764 - RNA, 1563 nt, Artificial Sequence
  derived and/or modified sequence opt3 from VP1__Norovirus_and/or_Norovirus-like__KT864687
augaagauggccagcaacgacgcugcacccuccaaugauggcgccgcggggcuggugccugagggaaacaaugaaacccucccacuugagccggucgcuggugccgcaaucgccgcucccguuacaggccagaacaauauuauagacccuuggaucagaacuaacuucgugcaagcaccaaauggggaauuuacgguaucucccaggaacucaccuggagagauucuguugaauuuagaacugggcccagaucuaaaccccuaccucgcccaccugagucggauguauaaugguuacgcugggggaguggagguccaggugcuucuggccggcaacgcguucaccgcaggcaaaaucuuguuugccgcuguuccuccaaauuucccgguggaguuucucagccccgcccagauuacaaugcugccucaucugaucgucgacgugcgcacucucgaaccaauaaugauccccuuaccugauguacgaaacaccuucuuucacuauuccaaucagccaaacucucguaugagacugguugcaaugcuuuacacacccuugaggucgaacgggucaggagacgauguguucaccgucagcugccgggugcugacucgcccgacaccugacuuugaguucaccuaucuagugcccccaagugucgaauccaagacgaaaccuuuuucucuccccauucugacucuuagcgagcugaccaauuccagauucccaguucccaucgauucauuguuuacagcucaaaacaaugugcuccagguacagugucagaacgguaggugcacucuggacggcgaguuacaagggaccacacagcugcucccuaguggaauuugugccuuccggggccgcgugaccgcgcagaucaaucagcgagauagauggcauaugcaacuucagaaccugaaugguacgacuuacgacccaacagaugacgucccggcccccuuggggaccccugacuucaagggagugguuuuuggcauggugagccagaggaacgucggcaaugaugcaccagggucuacucgggcucaacaggccuggguguccacauauucaccccaguucguaccuaaacuaggaagcguuaaccugcguauaagugacaaugaugacuuucaguuccaaccaaccaaguuuacgcccgugggugucaacgaugacgaugacggccacccguuccgccagugggaacucccuaauuacucuggggagcugacccuuaacaugaaucuggcuccacccguggccccuaacuuucccggagaacagcucuuguucuuuagauccuucgucccaugcagcggcgguuacaaccaggggauuaucgauugucugauuccucaagaguggauccagcauuuuuaucaggaaucggcacccucucaguccgacguggccuuaaucagguacguuaauccagauacaggccggacucuguucgaggcuaagcuacaccgaucaggauauauuaccguggcgcacaguggcgacuacccgcucguagucccugcaaacgggcauuuucgcuucgagagcugguga

SEQ ID NO: 21765 - RNA, 1563 nt, Artificial Sequence
  derived and/or modified sequence opt3 from VP1__Norovirus_and/or_Norovirus-like__KX764842
augaagauggccagcaacgacguggcucccuccaaugauggcgcagccgggcuggucccugagggaaacaaugaaacccucccacuugagccgguugcgggugcugccaucgcagcccccgugacaggccagaacaauauuauagacccuuggaucagaacuaacuucguacaagcuccaaauggggaauuuacggugucucccaggaacucaccuggagagauucuguugaauuuagaacugggcccagaucuaaaccccuaccucgcacaccugagucggauguauaaugguuacgccgggggagucgaggugcagguucuucuggcuggcaacgccuucaccgcgggcaaaaucuuguuugcagccgugccuccaaauuucccggucgaguuucucagccccgcucagauuacaaugcugccucaucugaucguggacguacgcacucucgaaccaauaaugauccccuuaccugauguucgaaacaccuucuuucacuauuccaaucagccaaacucucguaugagacugguggccaugcuuuacacacccuugaggucgaacgggucaggagacgaugucuucaccgugagcugccgggugcugacucgcccgacaccugacuuugaguucaccuaucuaguucccccaagugucgaauccaagacgaaaccuuuuucucuccccauucugacucuuagcgagcugaccaauuccagauucccagugcccaucgauucauuguuuacagcacaaaacaauguacuccaggugcagugucagaacgguaggugcacucuggacggcgaguuacaagggaccacacagcugcucccuaguggaauuugugcuuuccggggccgcgucaccgcccagaucaaucagcgagauagauggcauaugcaacuucagaaccugaaugguacgacuuacgacccaacagaugacgugccggcgcccuuggggaccccugacuucaagggaguuguguuuggcauggucagccagaggaacgugggcaaugaugccccagggucuacucgggcacaacaggcuuggguauccacauauucaccccaguucguuccuaaacuaggaagcgugaaccugcguauaagugacaaugaugacuuucaguuccaaccaaccaaguuuacgcccgucggugugaacgaugacgaugacggccacccguuccgccagugggaacucccuaauuacucuggggagcugacccuuaacaugaaucuggccccacccgucgcuccuaacuuucccggagaacagcucuuguucuuuagauccuucgugccaugcagcggcgguuacaaccaggggauuaucgauugucugauuccucaagaguggauccagcauuuuuaucaggaaucggcccccucucaguccgacguugcauuaaucagguacgugaauccagauacaggccggacucuguucgaggccaagcuacaccgaucaggauauauuaccguagcucacaguggcgacuacccgcucgucgugccugcgaacgggcauuuucgcuucgacgcaugguga

SEQ ID NO: 21766 - RNA, 1563 nt, Artificial Sequence
  derived and/or modified sequence opt3 from VP1__Norovirus_and/or_Norovirus-like__KT864685
augaagauggccagcuccgacgcugcacccucuaacgauggcgccgcggggcuggugccugagggaaauaacgaaacccucccacuugagccggucgcuggugccgcaaucgccgcucccguuacaggccagaauaacauuauagacccuuggaucagaacuaauuucgugcaagcaccaaacggggaauuuacgguaucacccaggaauaguccuggagagauucuguugaacuuagaacugggcccagaucuaaaucccuaccucgcccaccugagccggauguauaacgguuacgcugggggaguggagguccaggugcuucuggccggcaaugcguucaccgcaggcaaaaucuuguuugccgcuguuccuccaaacuucccgguggaguuucucucccccgcccagauuacaaugcugccucaucugaucgucgacgugcgcacucucgaaccaauaaugauccccuuaccugauguacgaaauaccuucuuucacuauucuaaccagccaaauucgcguaugagacugguugcaaugcuuuacacacccuugaggucaaacgggagcggagacgauguguucaccgucaguugccgggugcugacucgcccgacaccugacuuugaguucaccuaucuagugcccccauccgucgaaucuaagacgaaaccuuuuagccuccccauucugacucuuuccgagcugaccaacucaagauucccaguucccaucgauaguuuguuuacagcucaaaauaacgugcuccagguacagugucagaaugguaggugcacucuggacggcgaguuacaagggaccacacagcugcucccuagcggaauuugugccuuccggggccgcgugaccgcgcagaucaaccagcgagauagauggcauaugcaacuucagaaucugaacgguacgacuuacgacccaacagaugacgucccggcccccuuggggaccccugacuucaagggagugguuuuuggcauggugucucagaggaaugucggcaacgaugcaccaggguccacucgggcucaacaggccugggugucaacauauagcccccaguucguaccuaaacuaggaccaguuaaucugcguauaagugacaacgaugacuuucaguuccaacccaccaaguuuacgccggugggugucaaugaugacgaugacggccacccuuuccgccagugggaacucccaaacuacucuggggagcugacccuuaauaugaaccuggcucccccuguggcccccaauuuuccaggagaacagcucuuguucuuuagauccuucgucccuugcagcggcgguuacaaccaggggauuaucgauugucugauuccccaagaguggauccagcauuuuuaucaggaaucggcaccaucucaguccgacguggccuuaaucagguacguuaacccggauacaggccggacucuguucgaggcuaagcuacaccgaucaggauauauuaccguggcgcacaguggcgacuacccucucguaguccccgcaaaugggcauuuucgcuucgacagcugguga

SEQ ID NO: 21767 - RNA, 1563 nt, Artificial Sequence
  derived and/or modified sequence opt3 from VP1__Norovirus_and/or_Norovirus-like__KT864684
augaagauggccagcuccgacgcugcacccucuaacgauggcgccgcggggcuggugccugagggaaauaacgaaacccucccacuugagccggucgcuggugccgcaaucgccgcucccguuacaggccagaauaacauuauagacccuuggaucagaacuaauuucgugcaagcaccaaacggggaauuuacgguaucacccaggaauaguccuggagagauucuguugaacuuagaacugggcccagaucuaaaucccuaccucgcccaccugagccggauguauaacgguuacgcugggggaguggagguccaggugcuucuggccggcaaugcguucaccgcaggcaaaaucuuguuugccgcuguuccuccaaacuucccgguggaguuucucucccccgcccagauuacaaugcugccucaucugaucgucgacgugcgcacucucgaaccaauaaugauccccuuaccugauguacgaaauaccuucuuucacuauucuaaccagccaaauucgcguaugagacugguugcaaugcuuuacacacccuugaggucaaacgggagcggagacgauguguucaccgucaguugccgggugcugacucgcccgacaccugacuuugaguucaccuaucuagugcccccauccgucgaaucuaagacgaaaccuuuuagccuccccauucugacucuuuccgagcugaccaacucaagauucccaguucccaucgauaguuuguuuacagcucaaaauaacgugcuccagguacagugucagaaugguaggugcacucuggacggcgaguuacaagggaccacacagcugcucccuagcggaauuugugccuuccggggccgcgugaccgcgcagaucaaccagcgagauagauggcauaugcaacuucagaaucugaacgguacgacuuacgacccaacagaugacgucccggcccccuuggggaccccugacuucaagggagugguuuuuggcauggugucucagaggaaugucggcaacgaugcaccaggguccacucgggcucaacaggccugggugucaacauauagcccccaguucguaccuaaacuaggaaguguuaaucugcguauaucugacaacgaugacuuucaguuccaaccaaccaaguuuacgcccgugggugucaaugaugacgaugacggccacccguuccgccagugggaacucccuaacuacuccggggagcugacccuuaauaugaaccuggcuccacccguggccccuaauuuucccggagaacagcucuuguucuuuaggagcuucgucccaugcucgggcgguuacaaccaggggauuaucgauugucugauuccucaagaguggauccagcauuuuuaucaggaaucugcacccucccagucagacguggccuuaaucagauacguuaacccagauacaggccggacucuguucgaggcuaagcuacaccgaaguggauauauuaccguggcgcacagcggcgacuacccgcucguagucccugcaaaugggcauuuucgcuucgaguccugguga

SEQ ID NO: 21768 - RNA, 1563 nt, Artificial Sequence
  derived and/or modified sequence opt3 from VP1__Norovirus_and/or_Norovirus-like__KX764836
augaagauggccagcuccgacgcugcacccucuaacgauggcgccgcggggcuggugccugagggaaauaacgaaacccucccacuugagccggucgcuggugccgcaaucgccgcucccguuacaggccagaauaacauuauagacccuuggaucagaacuaauuucgugcaagcaccaaacggggaauuuacgguaucacccaggaauaguccuggagagauucuguugaacuuagaacugggcccagaucuaaaucccuaccucgcccaccugagccggauguauaacgguuacgcugggggaguggagguccaggugcuucuggccggcaaugcguucaccgcaggcaaaaucuuguuugccgcuguuccuccaaacuucccgguggaguuucucucccccgcccagauuacaaugcugccucaucugaucgucgacgugcgcacucucgaaccaauaaugauccccuuaccugauguacgaaauaccuucuuucacuauucuaaccagccaaauucgcguaugagacugguugcaaugcuuuacacacccuugaggucaaacgggagcggagacgauguguucaccgucaguugccgggugcugacucgcccgacaccugacuuugaguucaccuaucuagugcccccauccgucgaaucuaagacgaaaccuuuuagccuccccauucugacucuuuccgagcugaccaacucaagauucccaguucccaucgauaguuuguuuacagcucaaaauaacgugcuccagguacagugucagaaugguaggugcacucuggacggcgaguuacaagggaccacacagcugcucccuagcggaauuugugccuuccggggccgcgugaccgcgcagaucaaccagcgagauagauggcauaugcaacuucagaaucugaacgguacgacuuacgacccaacagaugacgucccggcccccuuggggaccccugacuucaagggagugguuuuuggcauggugucucagaggaaugucggcaacgaugcaccaggguccacucgggcucaacaggccugggugucaacauauagcccccaguucguaccuaaacuaggaaguguuaaucugcguauaucugacaacgaugacuuucaguuccaaccaaccaaguuuacgcccgugggugucaaugaugacgaugacggccacccguuccgccagugggaacucccuaacuacuccggggagcugacccuuaauaugaaccuggcuccacccguggccccuaauuuucccggagaacagcucuuguucuuuaggagcuucgucccaugcucgggcgguuacaaccagggggugauugauugucugaucccucaagaguggauucagcauuuuuaucaggaaucugcacccucccagucagacguugccuuaaucagauacgugaacccagauacaggccggacucuguucgaggcuaagcuacaccgaaguggauauaucaccguagcgcacagcggcgacuacccgcucgucgugccugcaaaugggcauuuucgcuucgaggccugguga

SEQ ID NO: 21769 - RNA, 1563 nt, Artificial Sequence
  derived and/or modified sequence opt3 from VP1__Norovirus_and/or_Norovirus-like__KX764845
augaagauggccagcuccgacgcugcacccucuaacgauggcgccgcggggcuggugccugagggaaauaacgaaacccucccacuugagccggucgcuggugccgcaaucgccgcucccguuacaggccagaauaacauuauagacccuuggaucagaacuaauuucgugcaagcaccaaacggggaauuuacgguaucacccaggaauaguccuggagagauucuguugaacuuagaacugggcccagaucuaaaucccuaccucgcccaccugagccggauguauaacgguuacgcugggggaguggagguccaggugcuucuggccggcaaugcguucaccgcaggcaaaaucuuguuugccgcuguuccuccaaacuucccgguggaguuucucucccccgcccagauuacaaugcugccucaucugaucgucgacgugcgcacucucgaaccaauaaugauccccuuaccugauguacgaaauaccuucuuucacuauucuaaccagccaaauucgcguaugagacugguugcaaugcuuuacacacccuugaggucaaacgggagcggagacgauguguucaccgucaguugccgggugcugacucgcccgacaccugacuuugaguucaccuaucuagugcccccauccgucgaaucuaagacgaaaccuuuuagccuccccauucugacucuuuccgagcugaccaacucaagauucccaguucccaucgauaguuuguuuacagcucaaaauaacgugcuccagguacagugucagaaugguaggugcacucuggacggcgaguuacaagggaccacacagcugcucccuagcggaauuugugccuuccggggccgcgugaccgcgcagaucaaccagcgagauagauggcauaugcaacuucagaaucugaacgguacgacuuacgacccaacagaugacgucccggcccccuuggggaccccugacuucaagggagugguuuuuggcauggugucucagaggaaugucggcaacgaugcaccaggguccacucgggcucaacaggccugggugucaacauauagccuacaguucguacccaaacugggaaguguuaaucuccguauaucugacaacgaugacuuucaguuccaaccuaccaaguuuacgccagugggugucaaugaugacgaugacggccaccccuuccgccagugggaacugccgaacuacuccggggagcuuacccugaauaugaacuuggcuccuccaguggcccccaauuuuccuggagaacagcuccuguucuuuaggagcuucguccccugcucgggcgguuacaaccaggggauuaucgauuguuuaauuccacaagaguggauccagcauuuuuaucaggaaucugcaccuucccagucagacguggcccugaucagauacguuaaccccgauacaggccggacucuauucgaggcuaagcuccaccgaaguggauauauuaccguggcgcacagcggcgacuacccacugguagucccggcaaaugggcauuuucgcuucgaggccugguga

SEQ ID NO: 21770 - RNA, 1563 nt, Artificial Sequence
  derived and/or modified sequence opt3 from VP1__Norovirus_and/or_Norovirus-like__KX764837
augaagauggccagcaacgacgcugcacccuccaaugauggcgccgcggggcuggugccugagggaaacaaugaaacccucccacuugagccggucgcuggugccgcaaucgccgcucccguuacaggccagaacaauauuauagacccuuggaucagaacuaacuucgugcaagcaccaaauggggaauuuacgguaucucccaggaacucaccuggagagauucuguugaauuuagaacugggcccagaucuaaaccccuaccucgcccaccugagucggauguauaaugguuacgcugggggaguggagguccaggugcuucuggccggcaacgcguucaccgcaggcaaaaucuuguuugccgcuguuccuccaaauuucccgguggaguuucucagccccgcccagauuacaaugcugccucaucugaucgucgacgugcgcacucucgaaccaauaaugauccccuuaccugauguacgaaacaccuucuuucacuauuccaaucagccaaacucucguaugagacugguugcaaugcuuuacacacccuugaggucgaacgggucaggagacgauguguucaccgucagcugccgggugcugacucgcccgacaccugacuuugaguucaccuaucuagugcccccaagugucgaauccaagacgaaaccuuuuucucuccccauucugacucuuagcgagcugaccaauuccagauucccaguucccaucgauucauuguuuacagcucaaaacaaugugcuccagguacagugucagaacgguaggugcacucuggacggcgaguuacaaggggccacccagcugcucccuaguggaauuugugcguuccggggccgcgugacagcccagaucaaucagcgagauagauggcauaugcaacuucagaaccugaaugguaccacguacgacccaacugaugacgucccggcacccuuggggacaccugacuucaagggagugguuuuuggcauggugagccagaggaacgucggcaaugaugugccagggucuacccgggcucaacaggccuggguauccacuuauucaccccaguucguuccuaaacuaggaagcgugaaccugcguauaagugacaaugaugacuuucaguuccaaccaacaaaguuuacccccgucggugugaacgaugacgaugacggccacccguuccgccagugggaacucccuaauuacucuggggagcugacgcuuaacaugaaucuggcuccacccgucgccccuaacuuucccggagaacagcucuuguucuuuagauccuucgugccaugcagcggcgguuacaaccaggggguuauugauugucugaucccucaagaguggauucagcauuuuuaucaggaaucggcacccucucaguccgacguggccuuaaucagguacguaaauccagauaccggccggacacuguucgaggcuaagcuacaccgaucaggauauaucacugucgcgcacaguggcgacuacccgcucgugguuccugcaaacgggcauuuucgcuucgacgccugguga

SEQ ID NO: 21771 - RNA, 1563 nt, Artificial Sequence
  derived and/or modified sequence opt3 from VP1__Norovirus_and/or_Norovirus-like__KX764838
augaagauggccagcaacgacgcugcacccuccaaugauggcgccgcggggcuggugccugagggaaacaaugaaacccucccacuugagccggucgcuggugccgcaaucgccgcucccguuacaggccagaacaauauuauagacccuuggaucagaacuaacuucgugcaagcaccaaauggggaauuuacgguaucucccaggaacucaccuggagagauucuguugaauuuagaacugggcccagaucuaagucccuaccucgcccaccugagccggauguauaacgguuacgcugggggaguggagguccaggugcuucuggccggcaaugcguucaccgcaggcaaaaucuuguuugccgcuguuccuccaaacuucccgguggaguuucucucccccgcccagauuacaaugcugccucaucugaucgucgacgugcgcacucucgaaccaauaaugauccccuuaccugauguacgaaauaccuucuuucacuauucuaaccagccaaauucgcguaugagacugguugcaaugcuuuacacacccuugaggucaaacgggagcggagacgauguguucaccgucaguugccgggugcugacucgcccgacaccugacuuugaguucaccuaucuagugcccccauccgucgaaucuaagacgaaaccuuuuagccuccccauucugacucuuuccgagcugaccaacucaagauucccaguucccaucgauaguuuguuuacagcucaaaauaacgugcuccagguacagugucagaaugguaggugcacucuggacggcgaguuacaagggaccacacagguggucccuagcggaauuugugccuuccggggccgcgugaccgcgcagaucaaccagcgagauagauggcauaugcaacugcagaaucucaacucuacgacuuacgacccaacagaugacguuccggcaccccuugguaccccugacuucaaggggguggucuuuggaauggugucccagaggaauguaggcaacgaugccccaggcucaacucgggcucaacaggccuggguuagcacauauaguccccaguucgugccuaaacuggggucugucaauuugcguauauccgacaacgaugacuuucaguuccaaccaaccaaguuuacgcccgugggagucaaugaugacgaugacggucacccguuccgccagugggaacuaccuaacuacagcggcgagcugacccucaauaugaaccuggcuccacccguggccccuaauuuucccggggaacagcuucuguucuuuagaucguucguuccaugcucuggaggcuacaaccaggguauuaucgauuguuugauuccucaagaguggauccagcauuuuuaucaggaauccgcacccucacagagugacguggcccucaucagguacguaaacccagauacagggcggacucuguucgaggcuaaguuacaccgaagcggcuauauugcggucgcacacuccggagacuacccgcuggugguuccugccaauggccauuuucgcuucgacucuugguga

SEQ ID NO: 21772 - RNA, 1563 nt, Artificial Sequence
  derived and/or modified sequence opt3 from VP1__Norovirus_and/or_Norovirus-like__KU687016
augaagauggccagcaacgacgcugcacccuccaaugauggcgccgcggggcuggugccugagggaaacaaugaaacccucccacuugagccggucgcuggugccgcaaucgccgcucccguuacaggccagaacaauauuauagacccuuggaucagaacuaacuucgugcaagcaccaaauggggaauuuacgguaucucccaggaacucaccuggagagauucuguugaauuuagaacugggcccagaucuaaaccccuaccucgcccaccugagucggauguauaaugguuacgcugggggaguggagguccaggugcuucuggccggcaacgcguucaccgcaggcaaaaucuuguuugccgcuguuccuccaaauuucccgguggaguuucucagccccgcccagauuacaaugcugccucaucugaucgucgacgugcgcacucucgaaccaauaaugauccccuuaccugauguacgaaacaccuucuuucacuauuccaaucagccaaacucucguaugagacugguugcaaugcuuuacacacccuugaggucgaacgggucaggagacgauguguucaccgucagcuuucgggugcugacucgcccgacaccugacuucgaguuuaccuaucuagugcccccaagugucgaauccagaacgaagccuuucucucuccccauucugacucuuagcgagcugaccaauuccagguuuccaguucccaucgauucauuguucacagcucaaaacaaugugcuccagguacagugccagaacggucgguguacucuggacggcgaguuacaagggaccacacagcugcucccuaguggaauuugcgccuuccgcggccaggugaccgcgcagaucaaucaacgagauagauggcauaugcagcuucagaaccugaaugguacgacuuacgacccaacagaugacgucccggcccccuuggggaccccugacuuuaaaggagugguuuucggcauggugagccaaaggaacgucggcaaugaugcaccagggucuacucgggcucagcaggccuggguguccacauauucaccccaguuuguaccuaagcuaggaagcauaaaccugcguauuagugacaaugaugacuuccaauuucagccaaccaaauucacgcccguuggugugaacgaugacgaugacggccacccguuucgccagugggaacucccuaauuacucuggggagcugacccuuaacaugaaucuggcuccacccgucgccccuaacuuccccggagaacaguugcucuuuuucagauccuuugugccauguagcggcgguuacaaccaagggaucauugauugccugaucccucaggaguggauccagcauuucuaucaggaaucggcacccucucaauccgacgucgccuuaauuagguacgugaauccagauacaggccggacucuguuugaggcuaagcuacaccgaucaggauauauaaccguugcgcacaguggcgacuacccgcucgugguaccugcaaacgggcauuuccgcuucgacgccugguga

SEQ ID NO: 21773 - RNA, 1563 nt, Artificial Sequence
  derived and/or modified sequence opt3 from VP1__Norovirus_and/or_Norovirus-like__KU687015
augaagauggccagcuccgacgcugcacccucuaacgauggcgccgcggggcuggugccugagggaaauaacgaaacccucccacuugagccggucgcuggugccgcaaucgccgcucccguuacaggccagaauaacauuauagacccuuggaucagaacuaauuucgugcaagcaccaaacggggaauuuacgguaucacccaggaauaguccuggagagauucuguugaacuuagaacugggcccagaucuaaaucccuaccucgcccaccugagccggauguauaacgguuacgcugggggaguggagguccaggugcuucuggccggcaaugcguucaccgcaggcaaaaucuuguuugccgcuguucucccuaacuucccaguggaguuucuguccccggcccagauuacaaugcugccccaucucaucgucgacgugcgcacuuuagaaccuauaaugaucccacugcccgauguacgaaauaccuucuuucacuauucuaaccagccuaauucgcguaugagacuuguugcaauguuguacacaccacugaggucaaacgggagcggagacgauguguucaccgucaguugccgggugcuaacucgccccacaccggacuuugaguucaccuaucucgugccucccuccgucgaaucuaagacgaaaccauuuagccugccuauucuuacucuguccgaguugaccaacucaagauuccccguuccaaucgauccccucuuuacagcucaaaauaacgugcugcagguacagugucagaaugguaggugcacuuuagacggcgagcugcaagggaccacacagcuccuuccuaguggaauuugugccuuccggggccgcgugaccgcgcagaucaaccagcgagauagauggcauauacaacugcagaauuugaacgguacgacuuacgacccaacagaugacgucccggcaccccuagggaccccugacuucaagggagugguuuuuggcauggugagccagaggaaugucggcaacgaugccccagggucuacucgggcucaacaggccuggguguccacauauucaccccaguucguaccuaaacugggaagcauuaaucuccguaucagugacaacgaugacuuucaguuccaaccaaccaaguuuacgcccguuggugugaaugaugacgaugacggccacccguuccgccagugggaacugccuaacuacucuggggagcuuacccugaauaugaacuuggcuccacccgucgccccuaauuuucccggagaacagcuccuguucuuuagauccuucgugccaugcagcggcgguuacaaccaggggauuaucgauuguuuaaucccucaagaguggauucagcauuuuuaucaggaaucggcacccucucaguccgacgucgcccugauaagguacgugaacccagauacaggccggacucuauucgaggcuaagcuccaccgaucaggauauaucaccguugcgcacaguggcgacuacccgcuggugguaccugcaaaugggcauuuucgcuucgacgccugguga

SEQ ID NO: 21774 - RNA, 1563 nt, Artificial Sequence
  derived and/or modified sequence opt3 from VP1__Norovirus_and/or_Norovirus-like__KU687013
augaagauggccagcuccgacgcugcacccucuaacgauggcgccgcggggcuggugccugagggaaauaacgaaacccucccacuugagccggucgcuggugccgcaaucgccgcucccguuacaggccagaauaacauuauagacccuuggaucagaacuaauuucgugcaagcaccaaacggggaauuuacgguaucacccaggaauaguccuggagagauucuguugaacuuagaacugggcccagaucuaaaucccuaccucgcccaccugagccggauguauaacgguuacgcugggggaguggagguccaggugcuucuggccggcaaugcguucaccgcaggcaaaaucuuguuugccgcuguuccuccaaacuucccgguggaguuucucucccccgcccagauuacaaugcugccucaucugaucgucgacgugcgcacucucgaaccaauaaugauccccuuaccugauguacgaaauaccuucuuucacuauucuaaccagccaaauucgcguaugagacugguugcaaugcuuuacacacccuugaggucaaacgggagcggaggugacguguucaccgucaguugccgggugcugacucgcccgacaccugauuuugaguucaccuaucuagugcccccauccgucaagucuaaaacgaagccuuuuagccuccccauucugacucuuuccgaacugaccaacucaagauucccaguucccaucgacaguuuguuuacagcucaaaauaacgugcuccagguacagugucagaauggcagaugcacucuggauggggaguuacaaggaaccacacagcugcucccuagcggcauuugugccuuccggggucgcgugaccgcgcagaucaaccagcgagacagauggcauaugcaacuucagaaucugaacgggacgacuuacgauccaacagacgaugucccggcccccuugggaaccccugacuucaaaggcgugguuuuuggcauggugucucagaggaaugucgggaacgacgcaccaggauccacucgggcucaacaggccugggugucaacauauagcccccaguucguaccuaagcuagguaguauaaaucugcguauuucugauaacgacgauuuucaguuccaaccaaccaaguuuacgcccguuggcgugaaugacgaugacgaugggcacccguuccgccagugggagcucccuaacuacuccggagaacugacccuuaauaugaaccuggcuccacccgucgccccuaauuuucccggcgagcagcucuuguucuuuaggagcuucgugccaugcucggguggguacaaccagggcaucauugacugucugaucccucaagaauggauccagcauuuuuaucaggagucugcacccucccagucagaugucgccuuaauuagguacgugaacccagacacaggacggacucuguucgaagcuaaacuacaccgaaguggcuauauaaccguugcgcacagcggggauuacccgcucgugguaccugcaaauggacauuuucgcuucgaguccugguga

SEQ ID NO: 21775 - RNA, 1563 nt, Artificial Sequence
  derived and/or modified sequence opt3 from VP1__Norovirus_and/or_Norovirus-like__KX764839
augaagauggccagcuccgacgcugcacccucuaacgauggcgccgcggggcuggugccugagggaaauaacgaaacccucccacuugagccggucgcugguacagccaucgcagcccccguuacuggccagaauaacauuauagacccuuggaucagaacgaauuucgugcaagcuccaaacggggaauuuaccguaucacccaggaauaguccuggagagauucuguugaacuuagaacugggcccagaucuaaaucccuaccucgcacaccugagccggauguauaacgguuacgccgggggaguggagguccaggugcuucuggcuggcaaugccuucacagcgggcaaaaucuuguuugcagccguuccuccaaacuucccgguggaguuucucucccccgcucagauuacuaugcugccucaucugaucgucgacgugcgcacccucgggccaauaaugauccccuuaccugauguacgaaauacauucuuucacuauucuaaccagccaaauucgcguaugagacugguugccaugcuuuacacccccuugaggucaaacggaagcggugacgauguguucacugucaguugccgggugcugacacgcccgaccccugacuuugaguucacguaucuagugcccccauccgucgaaucuaagacuaaaccuuuuagccuccccauucugacccuuuccgaacugacaaacucaagauucccaguucccaucgauaguuuguuuacugcacaaaauaacgugcuccagguacagugucagaauggcagaugcacccuggacggggaguuacaaggaacaacccagcugcucccuagcggcauuugugcuuuccggggucgcgugacggcccagaucaaccagcgagauagauggcauaugcaacuucagaaucugaacgggacuacauacgacccaaccgaugacgucccggcgcccuugggaacuccugacuucaagggcgugguuuuuggcauggugucucagaggaaugucgggaacgaugccccaggauccacacgggcacaacaggcuugggugucaaccuauagcccccaguucguaccuaaacuagguaguguuaaucugcguauaucugacaacgaugacuuucaguuccaaccaacgaaguuuacccccgugggcgucaaugaugacgaugacgggcacccguuccgccagugggagcucccuaacuacuccggagaacugacacuuaauaugaaccuggccccacccguggcuccuaauuuucccggcgagcagcucuuguucuuuaggagcuucgucccaugcucggguggguacaaccagggcauuaucgauugucugauuccucaagaauggauccagcauuuuuaucaggagucugcccccucccagucagacguggcauuaaucagguacguuaacccagauacuggacggacccuguucgaagccaagcuacaccgaaguggcuauauuacaguggcucacagcggggacuacccgcucguagucccugcgaauggacauuuucgcuucgaggcaugguga

SEQ ID NO: 21776 - RNA, 1563 nt, Artificial Sequence
  derived and/or modified sequence opt3 from VP1__Norovirus_and/or_Norovirus-like__KX764844
augaagauggccagcaacgacgcugcacccuccaaugauggcgccgcggggcuggugccugagggaaacaaugguacccucccacuugaaccggucgcuggcgccgcaaucgccgcucccguuacagggcagaacaauauuauagacccuuggaucagaauuaacuucgugcaagcaccaaauggagaguuuacuguaucucccaggaacucaccuggcgaaauccuguugaauuuagagcuggguccagaucuaaaccccuaccucgcccaccugagucggauguauaauggguacgcuggaggcguggaaguccaggugcuucuggccggcaacgcguucacggcagggaaaauuuuguuugccgcuguuccuccaaauuucccgguggaguuucucagccccgcccagaucaccaugcugccucaucugauagucgacgugcgcacacucgagccaaucaugauucccuuaccugauguacgaaacacuuucuuucacuauuccaaucagccaaacucucguaugggacugguugcaaugcuuuacacccccuugagaucgaacgguucaggcgacgauguguucacagucagcugcagggugcugacccggccgacuccugacuuugaguucacauaucuagugcccccaagugucgaauccaagaccaaaccuuuuucucuccccauccugacgcuuagcgaacugacuaauucccgcuucccaguucccauugauucauuguuuaccgcucaaaacaaugugcuccagguacagugucagaacgggagaugcacacuggacggagaguuacaaggcacuacccagcugcucccuagugguaucugugccuucagggggcgggugacagcgcagauaaaucagcgcgaucgauggcauaugcaacuucagaaccugaauggaaccacguacgacccaacugaugacgucccggcccccuugggcacaccugacuucaagggcgugguuuuugggauggugagccagagaaacgucggaaaugaugcaccagguucuaccagggcucaacaggccuggguguccacuuauucaccccaguucguaccuaaacuaggcagcguuaaccugcggauuagugacaaugaugacuuucaguuccaaccaacaaaguuuacccccgugggggucaacgaugacgaugacggacacccguuccgucagugggagcucccuaauuacucuggcgaacugacgcuuaacaugaaucuggcuccacccguggccccuaacuuucccggugagcagcucuuguucuuucgcuccuucgucccaugcagcgggggcuacaaccagggaaucauugauugucugaucccucaagaauggauccagcauuuuuaucaggagucggcacccucucaguccgacguggccuuaauuagauacguuaauccagauaccggcaggacacuguucgaagcuaagcuacaccggucaggguauauaacuguggcgcacaguggagacuacccgcucguagucccugcaaacggucauuuucgauucgagagcugguga

SEQ ID NO: 21777 - RNA, 1563 nt, Artificial Sequence
  derived and/or modified sequence opt3 from VP1__Norovirus_and/or_Norovirus-like__KT864686
augaagauggccagcuccgacgcugcacccucuaacgauggcgccgcggggcuggugccugagggaaauaacgaaacccucccacuugagccggucguuggugcugccaucgcagcccccgugacaggccagaauaacauuauagacccuuggaucagaacuaauuucguacaagcuccaaacggggaauuuacggugucacccaggaauaguccuggagagauucuguugaacuuagaacugggcccagaucuaaaucccuaccucgcacaccugagccggauguauaacgguuacgccgggggagucgaggugcagguucuucuggcuggcaaugccuucaccgcgggcaaaaucuuguuugcagccgugccuccaaacuucccggucgaguuucucucccccgcucagauuacaaugcugccucaucugaucguggacguacgcacucucgaaccaauaaugauccccuuaccugauguucgaaauaccuucuuucacuauucuaaccagccaaauucgcguaugagacugguggccaugcuuuacacacccuugaggucagacgggagcggagaugacgucuucaccgugaguugccgggugcugacucgcccgacaccugauuuugaguucaccuaucuaguucccccauccgucgaaucuaagacgaaaccuuuuagccuccccauucugacucuuuccgagcugaccaacucaagauucccagugcccaucgacaguuuguuuacagcacaaaacaauguacuccaggugcagugucagaacgguaggugcacucuggauggcgaguuacaagggaccacacagcugcucccuagcggaauuugugcuuuccggggccgcgucaccgcccagaucaaucagcgagacagauggcauaugcaacuucagaaccugaaugguacgacuuacgauccaacagacgacgugccggcgcccuuggggaccccugauuucaagggaguuguguuuggcauggucucucagaggaacgugggcaaugacgccccaggguccacucgggcacaacaggcuuggguaucaacauauagcccccaguucguuccuaaacuaggaagugugaaccugcguauaucugauaaugacgauuuucaguuccaaccaaccaaguuuacgcccgucggugugaacgacgaugacgauggccacccguuccgccagugggaacucccuaauuacuccggggagcugacccuuaacaugaaucuggccccacccgucgcuccuaacuuucccggaggccagcucuuguucuuuaggagcuucgugccaugcucggguggguacaaucagggcauuaucgacugucugauuccucaagaauggauccagcauuuuuaucaggagucugcccccucccagucagauguugcauuaaucagauacgugaacccagacacaggacggacucuguucgaagccaagcuacaccgaaguggcuauauuaccguagcucacagcggggacuacccgcucgucgugccugcgaacggacauuuucgcuucgaguccugguga

SEQ ID NO: 21778 - RNA, 1563 nt, Artificial Sequence
  derived and/or modified sequence opt3 from VP1__Norovirus_and/or_Norovirus-like__KU687012
augaagauggccagcuccgacgcugcacccucuaacgauggcgccgcggggcuggugccugagaucaauaccgaaacacucccacuugagccggucgcuggagccgcaauugccgcucccguuacuggucagaacaauauaaucgacccuuggauuagaaacaauuucgugcaagcaccaaacggcgaauuuacgguaucacccaggaauaguccuggggagauccugaugaacuuggaauuaggaccagaucugaaucccuaccuagcccaccucagccggauguauaacggcuacgcuggugggguggagguccaggugcugcuugccggaaaugcguucaccgcaggcaaaauucuguuugccgcuguuccuccaaacuucccgguggacauguugucccccgcccagaucacaaugcucccucaucugacugucgaugugcgcacccuggagccaauaaugaucccccucccugacguacgaaauguguuuuaucacuucaacaaucagccagcaccccguaugagauuaguugcuaugcuguacacaccgcuuaggucuaacggcucgggggaugacgucuuuaccgugucaugccggguguugacucgcccuacacccgauuucgaauuuaccuaucuggucccaccuagcguugagaguaagacgaaacccuucacucuaccaauucucaccaucggagaacugacaaacuccagauuucccgccccuauugaccaacuuuacacuucuccaaauaccgauauccuggugcagccgcagaacgguagguguacauuggacggcgagcuccaggggaccacgcaacuguuaacuacagcgauaugcagcuaucggggaaccacuuccaaucccacaucagauuacugggacgaccaucugcuccaccuuguacauccuaacggcgccaccuacgauccaacggaggacgugcccgcaccuuucgguacccaggauuuucgcgggauucuguauggagucuugacacagaauacucagaguccacgagacgaagugagcaacucuagaggcaucuacauuuccucaaccagcgauaaguucacacccaaacuaggcacuaucgggcugcaccaaguucagggagacaccgcuaguaaucagcaaucuaaguucacaccgguggguaucgccgucaaccagaauaccccuuuuaagcagugggagcucccaaacuauuccggcgcucugacucuuaauacgaaccuggcccccgcaguggggccuaauuuccccggagaacagauuuuguuuuucaggagcaacguaccaucgguucaaggcacacacccuacccaggagauagauugucucaucccccaggaauggauuucucauuuuuaccaggaguccgccccaucacaaagugacguggcucugguccgguaugugaauccggauacuggucguaccaucuucgaggcgaaauuacaccgccagggguuuauaacaauugcagccaccggcagcaacccugucgugguucccccaaacggauacuucagauuugacuccugguga

SEQ ID NO: 21779 - RNA, 1563 nt, Artificial Sequence
  derived and/or modified sequence opt3 from VP1__Norovirus_and/or_Norovirus-like__KU687018
augaagauggccagcaacgacgcugcacccuccaaugauggcgccgcggggcuggugccugagaucaacaccgaaacacucccacuugagccggucgcuggagccgcaauugccgcucccguuacuggucagaauaacauaaucgacccuuggauuagaaauaacuucgugcaagcaccaaauggcgaauuuacgguaucucccaggaacucaccuggggagauccugaugaauuuggaauuaggaccagaucugaaccccuaccuagcccaccucagucggauguauaauggcuacgcucgcgguguggagguccaggugcugcuugccgggaacgcguucaccgcaggaaaaauucuguuugccgcuguuccuccaaauuucccgguggacauguugagccccgcccagaucacaaugcucccucaucugauagucgaugugcgaacucuggagccaaucaugauuccccucccugacguacguaacgucuuuuaucacuucaauaaccagccagcacccagaaugagguuaguggcuaugcuguacaccccgcuucgguccaacggcucuggcgaugacgucuuuacagugucgugccgcguguugaccagaccuacucccgauuucgaauuuacauaucuggucccaccuucaguugagagcaagaccaaacccuucacgcuaccaauccucacuauuggggaacugaccaauaguagguuucccgccccuaucgaccaacuuuacacauccccaaacgcggaugugguagugcagccgcagaauggacgguguacucuggacggugaguugcagggcaccacacaacuccugaccacggccauaugcucuuaucgcgggacuacaagcaaccccaccuccgauuacugggacgaccauuuacugcaccucguccauccuaauggagcaacuuacgauccaacagaggacgugcccgcuccuuucggcacccaggauuuucgagguauucuuuaugggguucugacgcagaacacccagaauccaagagacgaagugucaaacaguaggggaaucuacauuagcucuacauccgauaaguucacucccaaauugggcaccaucggccuacaccaaguccagggggacacagccucaaaucagcaaagcaaguucacuccggugggaaucgcuguaaaccagaauaccccuuuuaagcagugggagcugccaaacuauaguggugcccucacacugaauaccaaccuugcacccgccguuggcccuaauuuccccggggaacagauucuguuuuuccggucuaacgugccauccguccaaggaaaccacccuacucaggagauagauuguuugaucccccaggaaugggugagccauuuuuaccaggagucggcuccaucucaauccgacgucgcgcucgugcguuauguuaauccggauacgggccgcacaauuuucgaggcaaaacugcacagacaggguuuuaucaccauagccgcuacugggucaaacccugugguaguucccccaaauggcuacuucagguuugaaaguugguga

SEQ ID NO: 21780 - RNA, 1563 nt, Artificial Sequence
  derived and/or modified sequence opt3 from VP1__Norovirus_and/or_Norovirus-like__KU687021
augaagauggccagcaacgacgcuacccccuccaaugauggcgcagccgggcuggugccugagaucaacacagaaacucucccacuugagccggucgcgggagcugccauugcagcccccguuacgggucagaauaacauaaucgacccuuggauuagaaauaacuucgugcaagcuccaaauggcgaauuuaccguaucucccaggaacucaccuggggagauccugaugaauuuggaauuaggaccagaucugaaccccuaccuagcacaccucagucggauguauaauggcuacgccggugggguggagguccaggugcugcuugcuggaaacgccuucacagcgggcaaaauucuguuugcagccguuccuccaaauuucccgguggacauguugagccccgcucagaucacuaugcucccucaucugauagucgaugugcgcacccuggagccaaucaugauuccccucccugacguacgaaacgucuuuuaucacuucaauaaccagccagcaccccguaugagauuaguggccaugcuguacacaccgcuuagguccaacggcucuggggaugacgucuuuaccgugucgugccggguguugacucgcccuacacccgauuucgaauuuaccuaucuggucccaccuucaguugagagcaagacgaaacccuucacucuaccaauccucaccauuggagaacugacaaauaguagauuucccgcuccuaucgaccaacuuuacacuuccccaaacgccgaugugguagugcagccgcagaaugguagguguacccuggacggcgaguugcaggggacaacccaacuccugacgacugcgauaugcucuuaucggggaacaaccagcaaccccacuuccgauuacugggacgaccauuuacugcaccucguccauccuaauggcgccacauacgauccaaccgaggacgugcccgcaccuuucgguacgcaggauuuucgcgggauucuuuauggaguucugacccagaacacacagaauccacgagacaaggugucaaacaguagaggcaucuacauuagcucuacuuccgauaaauucacccccaaguugggcacaaucgggcuacaccaaguccagggagacacugcuucaaaucagcaaagcaaguucaccccgguggguaucgccguaaaccagaauacaccuuuuaaacagugggaacugccaaacuauaguggcgcucucacccugaauacuaaccuugcccccgcaguugggccuaauuuccccggagagcagauucuguuuuucaggucuaacgugccauccguccaaggcaaccacccuacgcaggaaauagauuguuugaucccccaggagugggugagccauuuuuaccaggaaucggccccaucucaauccgacgucgcucucgugcgguauguuaauccggauacaggucguaccauuuucgaggcgaagcugcaccgccagggguuuaucauaauugcagccacuggcucaaacccugugguaguucccccaaauggauacuucagauuugagaguugguga

SEQ ID NO: 21781 - RNA, 1563 nt, Artificial Sequence
  derived and/or modified sequence opt3 from VP1__Norovirus_and/or_Norovirus-like__KU687020
augaagauggccagcuccgacgcugcacccucuaacgauggcgccgcggggcuggugccugagaucaauaccgaaacacucccacuugagccggucgcuggagccgcaauugccgcucccguuacuggucagaacaauauaaucgacccuuggauuagaaacaauuucgugcaagcaccaaacggcgaauuuacgguaucacccaggaauaguccuggggagauccugaugaacuuggaauuaggaccagaucugaaucccuaccuagcccaccucagccggauguauaacggcuacgcuggugggguggagguccaggugcugcuugccggaaaugcguucaccgcaggcaaaauucuguuugccgcuguuccuccaaacuucccgguggacauguugucccccgcccagaucacaaugcucccucaucugauagucgaugugcgcacucuggagccaaucaugauuccccucccugacguacgaaaugucuuuuaucacuucaacaaucagccagcaccccguaugagauuaguggcuaugcuguacaccccgcuuaggucuaacggcucgggggaugacgucuuuacagugucaugccggguguugacccgcccuacucccgauuucgaauuuacauaucuggucccaccuagcguugagaguaagaccaaacccuucacgcuaccaauccucacuauuggagaacugaccaacuccagauuucccgccccuaucgaccaacuuuacgcgucuccaaaugccgaugugguagugcagccgcagaacgguagguguacacuggacggcgaguugcaggggacuacccaacuccugacaaccgcaauaugcagcuaucggggaacgacuuccaaucccacaucagauuacugggacgaccauuuacugcaccucguccauccuaacggcgcuaccuacgauccaacugaggacgugcccgccccuuucgguacacaggauuuucgcgggauucuuuauggaguucugacccagaauacgcagaacccacgagacgaagugaguaauagcagaggcaucuacauuucuuccaccucagauaaguucacacccaaauugggcacuaucgggcuacaccaaguccagggagacaccgcuagcaaccagcaaaguaaguucacaccgguggguaucgccguaaaucagaacacuccuuuuaagcagugggagcugccaaauuauucuggcgcacucacccugaacacaaaucuugcccccgcuguugggccuaacuuccccggagaacagauucuguuuuucagguccaaugugccaagcguccaaggcaaccacccuacccaggagauagauuguuugaucccccaggaaugggugucgcauuuuuaccaggagucugcgccaucccaaucagacgucgcacucgugcgguauguuaacccggauacuggucguacgauuuucgaggccaaacugcaccgccagggguuuaucacaauagcugccaccggcaguaauccugugguaguucccccaaacggauacuucagauuugacgcaugguga

SEQ ID NO: 21782 - RNA, 1563 nt, Artificial Sequence
  derived and/or modified sequence opt3 from VP1__Norovirus_and/or_Norovirus-like__KU687014
augaagauggccagcaacgacgcugcacccuccaaugauggcgccgcggggcuggugccugagaucaacaccgaaacacucccacuugagccggucgcuggagccgcaauugccgcucccguuacuggucagaauaacauaaucgacccuuggauuagaaauaacuucgugcaagcaccaaauggcgaauuuacgguaucucccaggaacucaccuggggagauccugaugaauuuggaauuaggaccagaucugaaccccuaccuagcccaccucagucggauguauaauggcuacgcuggugggguggagguccaggugcugcuugccggaaacgcguucaccgcaggcaaaauucuguuugccgcuguuccuccaaauuucccgguggacauguugauccccgcccagauaacaaugcucccucaucugaucgucgaugugcgcacucuggagccaauuaugaucccccucccugacguacgaaacguguuuuaucacuucaauaaccagccagcaccccguaugagauuaguugcuaugcuguacaccccgcuuaggagcaacggcuccggggaugacgucuuuacagugucuugccggguguugacccgcccuacucccgauuucgaauuuacauaucuggucccaccuucgguugagucaaagaccaaacccuucacgcuaccaauucucacuaucggagaacugaccaauagcagauuucccgccccuauagaccaacuuuacacaaguccaaacgcggaugugguagugcagccgcagaaugguagguguacucuggacggcgaguugcaggggaccacacaacuccugaccacggccauuugcuccuaucggggaacuacaucuaaccccaccagcgauuacugggacgaccauuuacugcaccucguccauccuaauggcgcaacuuacgguccaacagaggaugugcccgcuccuuucgggacccaggacuuucgcggaauccuuuauggcguucugacgcagaacacccagaauccacgagaugaaguguccaacucaagaggcauuuacaucaguagcacaucugacaaguucacucccaaauuggggaccaucggacuacaccaaguccagggugauacagccuccaaucagcaaucaaaguucacuccggugggcauugcuguaaaccagaauaccccuuuuaagcagugggagcugccaaacuauagcggggcccucacacugaauaccaaccuugcacccgccguuggaccuaauuuccccggcgaacagauacuguuuuucaggaguaacgugccaucuguccaagguacucacccuacgcaggagaucgacuguuugauuccccaggaauggaucucccauuuuuaccaggagagcgcuccaucgcaaucugauguggcgcucguccgguaugugaacccggacacagggcguaccauauucgaggcaaaacugcaccgccagggcuuuauuacuaucgccgcuaccggauccaauccuguugugguacccccaaacggcuacuucagauuugaugccugguga

SEQ ID NO: 21783 - RNA, 1563 nt, Artificial Sequence
  derived and/or modified sequence opt3 from VP1__Norovirus_and/or_Norovirus-like__KU687019
augaagauggccagcaacgacgcugcacccuccaaugauggcgccgcggggcuggugccugagaucaacaccgaaacacucccacuugagccggucgcuggagccgcaauugccgcucccguuacuggucagaauaacauaaucgacccuuggauuagaaauaacuucgugcaagcaccaaauggcgaauuuacgguaucucccaggaacucaccuggggagauccugaugaauuuggaauuaggaccagaucugaaccccuaccuagcccaccucagucggauguauaauggcuacgcuggugggguggagguccaggugcugcuugccggaaacgcguucaccgcaggcaaaauucuguuugccgcuguuccuccaaauuucccgguggacauguugagccccgcccagaucacaaugcucccucaucugauagucgaugugcgcacucuggagccaaucaugauuccccucccugacguacgaaacgucuuuuaucacuucaauaaccagccagcaccccguaugagauuaguggcuaugcuguacaccccgcuuagguccaacggcucuggggaugacgucuuuacagugucgugccggguguugacccgcccuacucccgauuucgaauuuacauaucuggucccaccuucaguugagagcaagaccaaacccaguacgcuaccaauccucacuauuggagaacugaccaauuccagauuccccgccccuaucgaccaacuuuacacaucuccaaacgcggaugugguagugcagccgcagaaugguagguguacucuggacggcgaguugcaggggaccacacaacuccugaccacggccauaugcagcuaucggggaacuacauccaaccccaccucagauuacugggacgaccauuuacugcaccucguccauccuaauggcgcaacuuacgauccaacagaggacgugcccgcuccuuuugguacccaggauuuccgcgggauucuuuauggaguucugacgcagaacacccagaauccacgagacgaagugaguaacagcagaggcaucuacauuucuuccacaucagauaaguuuacucccaaauugggcaccaucgggcuacaccaaguccagggagacacagccagcaaucagcaaaguaaguucacuccgguggguaucgcuguaaaccagaauaccccuuucaagcagugggagcugccaaacuauucuggcgcccucacacugaauaccgaucuugcacccgccguugggccuaacuuucccggagaacagauucuguucuuuagguccaaugugccaagcguccaaggcaaccacccuacucaggagauagacuguuugaucccccaggaaugggugucgcauuucuaccaggagucugcuccaucccaaucagaugucgcgcucgugcgguauguuaacccggacacgggucguacaauuuuugaggcaaaacugcaccgccagggguucaccacuaucgccgcuaccggcaguaauccugugguaguucccccaaacggauacuuuagauucgaaagcugguga

SEQ ID NO: 21784 - RNA, 1563 nt, Artificial Sequence
  derived and/or modified sequence opt3 from VP1__Norovirus_and/or_Norovirus-like__KU687017
augaagauggccagcuccgacgcugcacccucuaacgauggcgccgcggggcuggugccugagaucaauaccgaaacacucccacuugagccggucgcuggagccgcaauugccgcucccguuacuggucagaacaauauaaucgacccuuggauuagaaacaauuucgugcaagcaccaaacggcgaauuuacgguaucacccaggaauaguccuggggagauccugaugaacuuggaauuaggaccagaucugaaucccuaccuagcccaccucagccggauguauaacggcuacgcuggugggguggagguccaggugcugcuugccggaaaugcguucaccgcaggcaaaauucuguuugccgcuguuccuccaaacuucccgguggacauguugucccccgcccagaucacaaugcucccucaucugauagucgaugugcgcacucuggagccaaucaugauuccccucccugacguacgaaauguguuuuaucacuucaacaaucagccagcaccccguaugagauuaguugcuguccuguacaccccgcuuaggucuaacggcucgggggaugacguguuuacagugucaugccgggucuugacccgcccuacucccgauuucgaauuuacauaucugguuccaccuagcguggagaguaagaccaaacccuucacgcuaccaauccucacuauuggagaacugaccaacuccagauuucccgccccuaucgaccaacuuuacacaucuccaaaugcggauguagugguccagccgcagaacgguagguguacucuggacggcgaguugcaggggaccacacaacuccugaccacggccauaugcagcuaucggggaacuacauccaaucccaccucagauuacugggacgaccauuuacugcaccucgugcauccuaacggcgcaacuuacgauccaacagaggacguucccgcuccuuucgguacccaggauuuucgcgggauucuuuauggagugcugacgcaggacacccagaauccacgagaugaagucaguaacagcagaggcaucuacauuucuuccacaucagacaaguucacucccaaauugggcaccaucgggcuacaccaagugcagggagauacagccagcaaucagcaaaguaaguucacuccgguagguaucgcuguuaaccagaauaccccuuuuaagcagugggagcugccaaacuauucuggcgcccucacacugaauaccaaccuugcacccgccguggggccuaauuuccccggagaacagauucuguuuuucagguccaacgucccaagcgugcaaggcaaucacccuacucaggagauagacuguuugaucccccaggaaugggucucgcauuuuuaccaggagucugcuccaucccaaucagauguggcgcucguucgguaugugaacccggacgcaggucguacgauuuucgaggccaaacugcaccgccagggguuuaucacaauagcugccaccggcaguaacccuguagucgugcccccaaauggauacuucagauuugaagcaugguga

SEQ ID NO: 21785 - RNA, 1563 nt, Artificial Sequence
  derived and/or modified sequence opt3 from VP1__Norovirus_and/or_Norovirus-like__KU687024
augaagauggccagcuccgacgcugcacccucuaacgauggcgccgcggggcuggugccugagaucaauaccgaaacacucccacuugagccggucgcuggagccgcaauugccgcucccguuacuggucagaacaauauaaucgacccuuggauuagaaacaauuucgugcaagcaccaaacggcgaaucaacgguaagucccaggaauagcccuggggagauccugaugaacuuggaauuaggaccagaucugaaucccuaccuagcccaccucucccggauguauaacggcuacgcuggugggguggagguccaggugcugcuugccggaaaugcguuuaccgcaggcaaaauucuguucgccgcuguuccuccaaacuuuccgguggacauguugucucccgcccagaucacaaugcucccucaucugauagucgaugugcgcacucuggagccaaucaugauuccccucccugacguacgaaauguuuucuaucacuuuaacaaucagccagcaccccguaugagauuaguggcuaugcuguacaccccgcuuaggucgaacggcgccggggaugacgucuucacagugucaugccggguguugacccgcccuacucccgauuuugaguucacauaucuggucccaccuagcguugaaaguaagaccaaacccuuuacgcuaccaauccucacuauuggagaacugaccaacuccagauuccccgcgccuaucgaccaacuuuacacaucuccaaauacugauauacuggugcagccgcagaacgguagguguaccuuggacggcgagcuccaggggacaacccaacuguuaacgacugccauuugcagcuaucggggaacaaccuccaaucccacuucagauuacugggacgaccaucugcuccaccuuguacauccuaacggcgcaacauacgauccaaccgaggacgugcccgcuccuuuugguacgcaggauuuccgcgggauccuguauggagucuugacccagaauacacagaacccacgagacgaagugaguaauagcagaggcauuuacaucucuuccacuucagauaaguuuacccccaaacuaggcacaaucgggcugcaccaaguucagggagacacugccagcaaccagcaaaguaaguucaccccgguggguauugcugucaaucagaacacaccuuucaagcagugggagcucccaaauuauucuggcgcccugacccuuaacacuaaucuggcacccgccguggggccuaacuuucccggagaacagauauuguucuuuagguccaauguaccaagcguucaaggcacgcacccuacacaggagaucgauugucucauuccccaggaauggaucucgcauuucuaccaggagucugcuccaucccaaucagacguggcgcugguccgguaugugaacccggauaccggucguacuauauuugaggcaaaauuacaccgccagggguucauuaccaucgccgcuacaggcaguaacccugucgugguucccccaaauggauacuuuagauucgaagccugguga

SEQ ID NO: 21786 - RNA, 1563 nt, Artificial Sequence
  derived and/or modified sequence opt3 from VP1__Norovirus_and/or_Norovirus-like__KU687022
augaagauggccagcaacgacgcugcacccuccaaugauggcgccgcggggcuggugccugagaucaacaccgaaacacucccacuugagccggucgcuggagccgcaauugccgcucccguuacuggucagaauaacauaaucgacccuuggauuagaaauaacuucgugcaagcaccaaauggcgaauuuacgguaucucccaggaacucaccuggggagauccugaugaauuuggaauuaggaccagaucugaaccccuaccuagcccacccuagucggauguauaauggcuacgcuggugggguggagguccaggugcuccuggccggaaacgcguucaccgcaggcaaaauucuuuuugccgcuguuccaccgaauuuccccguggacaugcugagcccuacacagaucacuauguugccacaucucaccgucgaugugcgcacacuggagcccauaaugaucccucugccagacguacgaaacguuuucuaucacuucaauaaccagcccgccccgcguaugagacucguggcaauguuauacaccccucugagguccaacggcucuggggaugacguccuuacugugucgugccggguguugacacgccccaccccagauuuugaauuuacguaucuggucccucccucaguugagagcaagacuaaaccauuuacccuacccauucucacaaucggagaacugacuaauaguagauucccugcuccaauugaccaacuuuacaccuccccgaacgccgaugugguagugcagccccagaaugguagguguacacuggacggcgaguugcaggggaccacgcaacuccugacuacagcgaucugcucuuaucggggaaccacuagcaacccuacauccgauuacugggacgaccauuuacugcaccucguccauccaaauggcgccaccuacgaucccacggaggacgugccugcaccauuugguacccaggauuuccgcgggauacuuuauggaguucugacacagaacacucagaauccccgagacgaagugucaaacaguagaggcauuuacaucagcucuaccuccgauaaguuuacaccgaaauugggcacuauugggcuacaccaaguccagggagacaccgcuucaaaucagcaaagcaaguucacaccuguggguaucgccguaaaccagaauaccccauucaagcagugggagcugcccaacuauaguggcgcucucacucugaauacgaaccuugccccugcaguugggcccaauuuuccaggagaacagauccuguucuuuaggucuaacgugccuuccguccaaggcaaccaccccacacaggagauugauuguuugauaccacaggaaugggugagccauuucuaccaggagucggccccgucucaauccgacgucgcucucgugcgguauguuaauccugauaccggucguacuaucuuugaggcgaaacugcaccgccagggguucauuaccaucgcagccacaggcucaaaccccgugguagucccacccaauggauacuuuagauucgaaaguugguga

SEQ ID NO: 21787 - RNA, 1563 nt, Artificial Sequence
  derived and/or modified sequence opt3 from VP1__Norovirus_and/or_Norovirus-like__KU687023
augaagauggccagcuccgacgcugcacccucuaacgauggcgccgcggggcuggugccugagaucaauaccgaaacacucccacuugagccggucgcuggagccgcaauugccgcucccguuacuggucagaacaauauaaucgacccuuggauuagaaacaauuucgugcaagcaccaaacggcgaauuuacgguaucacccaggaauaguccuggggagauccugaugaacuuggaauuaggaccagaucugaaucccuaccuagcccaccucagccggauguauaacggcuacgcuggugggguggagguccaggugcugcuugccggaaaugcguucaccgcaggcaaaauucuguuugccgcuguuccuccaaacuucccgguggacauguugucccccgcccagaucacaaugcucccucaucugauagucgaugugcgcacucuggagccaaucaugauuccccucccugacguacgaaauguguuuuaucacuucaacaaucagccagcaccccguaugagauuaguugcuaugcuguacaccccgcuuaggucuaacggcucgggggaugacgucuuuacagugucaugccggguguugacccgcccuacucccgauuucgaauuuacauaucuggucccaccuagcguugagaguaagaccaaacccuucacgcuaccaauccucacuauuggagaacugaccaacuccagauuucccgccccuaucgaccaacuuuacacaucuccaaauacugauauacuggugcagccgcagaacgguagguguaccuuggacggcgagcuccaggggacaacccaacuguuaacgacugcgauuugcagcuaucggggaacaaccuccaaucccacuucagauuacugggacggccaucugcuccaccuuguacauccuaacggugccacauacgacccaaccgaggaugugcccgcaccuuucgggacgcaggacuuucgcggaauccuguauggcgucuugacccagaauacacagaacccacgagaugaagugaguaauagcagaggcauuuacaucucuuccacuucagacaaguucacccccaaacuagggacaaucggacugcaccaaguucagggugauacugcuagcaaccagcaaaguaaguucaccccggugggcauugccgucaaucagaacacaccuuuuaagcagugggagcucccaaauuauucuggggcucugacccuuaacacuaaucuggcccccgcagugggaccuaacuuccccggcgaacagauauuguuuuucagguccaauguaccaagcguucaagguacgcacccuacacaggagaucgacugucucauuccccaggaauggaucucgcauuuuuaccaggagucugccccaucccaaucagauguggcucugguccgguaugugaacccggacaccgggcguacuauauucgaggcgaaauuacaccgccagggcuuuauugcaaucgccgcuaccggaaguaacccugucgugguucccccaaauggcuacuucagauuugaagccugguga

SEQ ID NO: 21788 - RNA, 1563 nt, Artificial Sequence
  derived and/or modified sequence opt3 from VP1__Norovirus_and/or_Norovirus-like__KX764847
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaagugaucuucgccgcaguaccuccaaacuuuccgacugagggccucucccccucucagguuacgauguucccucauauuguggucgacgugcgccaacuggagccagugcuuaucccccugccugauguccgaaauaacuuuuaucacuacaaucagucgaacgacccaaccauaaaguugaucgcuaugcucuauacaccccugcgugccaacaaugcgggggaugacguuuucacugugucaugcagaguacugaccaggccgagcccugauuuugacuucauuuuucucgugcccccaacagucgaaagucggaccaaaccuuucuccgugcccguuuuaacuguggaggaaaugacaaacucucgcuuuccaaucccccuggagaaacuuuucaccggaccuagcuccgccuucgucgugcagccacagaaugguagauguacgacugauggcguauugcuggggaccacacaacuaucaccgguuaacauuugcacuuuuaggggagacgugacccauaucacaggcaguagcaauuacaccaugaaccucgcaucucagaauugguccaacuaugaucccacggaggaaauaccugcuccacuggguacucccgacuucgucgggaagauucagggaaugcuuacacagaccacucggacagacggcucaacccgcggccacaaggccacgguguacaccgggagcgcugauuuugccccuaagcugggacgaguccaauucgagacagacacugaucaugacuuugaagcaaaucagaacaccaaauucacaccaguggguguuauccaggauggcaguacuacccacagaaaugagccccaacaguggguguugccgucuuacuccgggaggaacacaccuaauguacaccucgccccagcugucgcgcccaccuuuccuggagaacagcuguuauucuuucggagcacuaugcccggcuguucggguuauccaaacauggaccuggauugccuccuuccucaggagugggugcaauacuucuaucaggaggcagcccccgcucagucugacguugcccuguugcguuuugugaauccagauacggggcgcguccuauucgaauguaagcugcauaaauccggcuacgugacaguagcacacaccggacagcaugaccucgugauuccgccuaacggcuauuuuagauucgaggccugguga

SEQ ID NO: 21789 - RNA, 1563 nt, Artificial Sequence
  derived and/or modified sequence opt3 from VP1__Norovirus_and/or_Norovirus-like__KX764846
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaagugaucuucgccgcaguaccuccaaacuuuccgacugagggccucucccccucucagguuacgauguucccucauauuguggucgacgugcgccaacuggagccagugcuuaucccccugccugauguccgaaauaacuuuuaucacuacaaucagucgaacgacccacccauaaaguugaucgcuaugcucuauaccccgcugcgugccaacaaugcgggggaugacguuuucacagugucaugcagaguacugacuaggccuagccccgauuuugacuucauuuuucucgugccaccuaccgucgaaagucggacaaaacccuucuccgugccaguuuuaaccguggaggaaaugacuaacucucgcuuucccaucccucuggagaaacuuuucacaggaccaagcuccgccuucgucgugcagccgcagaaugguagauguaccacggauggcguauugcuggggacuacccaacuaucacccguuaacauuugcacauuuaggggagacgugacucauaucaccggcagucggaauuacacaaugaaccucgcaagccagaauuggucuaacuaugauccuaccgaggaaauaccagcuccccuggguacgccugacuucgucgggaagauucagggaaugcuuacucagacaacccgcacugacggcuccacacgaggccacaaggccaccguguacacggggucagcugauuuugccccaaagcugggaagaguccaauucgagaccgacacagaucaugacuuugaagcaaaucagaacacuaaauucacccccguggguguuauccaggauggcagcacaacucacaggaaugagccgcaacaguggguguugccuaguuacucugggcggaacaccccaaauguacaccucgcccccgcugucgcgccuacauuucccggagaacagcuguuauucuuucguuccaccaugccaggcuguagcgguuauccuaacauggaccuggauugccuccuuccccaggagugggugcaauacuucuaucaggaggcagccccagcucagucggacguugcccuguugcgcuuugugaauccggauacugggagaguccuauucgaauguaagcugcauaaaucuggcuacgugacgguagcacacacaggacagcaugaccucgugauuccucccaacggcuauuuuagguucgaugccugguga

SEQ ID NO: 21790 - RNA, 1563 nt, Artificial Sequence
  derived and/or modified sequence opt3 from VP1__Norovirus_and/or_Norovirus-like__KX764833
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucaucgaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaugacguguucacugucaguugcagaguucugaccaggcccuccccggauuuugacuucauuuuucucgugccucccacaguagaaucucggaccaaaccauucagcgugccugucuuaacuguggaggaaaugacaaauucccgcuuucccaucccacuggagaaacuuuucaccggacccucaagugccuucguugugcagccucagaacgguagauguacgacugauggcgucuugcuggggaccacacaacuaagcccagugaauauaugcacuuuuaggggagacguaacccauauuacaggcucucggaacuacaccaugaaucucgcaucccagaacuggaauaacuaugauccgacggaggaaauccccgcuccucuggguacuccagacuucguugggaagauucagggaaugcuuacacagaccacucgcacagacggcucaacccgaggccacagagccacgguguacaccgggagcgcugauuuugcccccaagcugggaaggguccaauucgagacagacacugaucaugacuuugaagcaaaucagaacaccaaguucacaccugugggugucauccaggauggcaguacuacccaccggaaugagccacaacaguggguguugcccucuuacuccgggcguaacacacacaauguucaucucgccccggcuguggcgccuaccuuuccaggagaacagcuguuauucuuucgcagcacuaugcccggcuguucggguuauccuaacauggaccuggauugccuccuuccccaggaguggguacaauacuucuaucaggaggcagccccagcucagucugacgucgcccuguugagauuugugaauccugauacggggaggguucuauucgaauguaaacugcacaaguccggcuacgugacagucgcacauaccggacagcacgaccucgugauucccccaaacggcuauuuucgguucgaugccugguga

SEQ ID NO: 21791 - RNA, 1563 nt, Artificial Sequence
  derived and/or modified sequence opt3 from VP1__Norovirus_and/or_Norovirus-like__KX764834
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucaucgaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaugacguguucacugucaguugcagaguucugaccaggcccuccccggauuuugacuucauuuuucucgugccucccacaguagaaucucggaccaaaccauucagcgugccugucuuaacuguggaggaaaugacaaauucccgcuuucccaucccacuggagaaacuuuucaccggacccucaagugccuucguugugcagccucagaacgguagauguacgacugauggcgucuugcuggacaccacacaacuaagcccagugaauauaugcacuuuuaggggagauguaacccauauuacagggucucggaacuacaccaugaaucucgcaucccagaacuggaauaacuaugacccgacggaggaaauccccgcuccucugggcacuccagacuucguugguaagauucaggggaugcuuacacagaccacucgcacagauggaucaacccgaggccacaaggccacgguguacaccggcagcgcugacuuugcccccaagcuggggagaguccaauucgagacagauacugaccaugauuuugaagcaaaucagaacaccaaauucacaccugugggagucauccaggacgguaguacuacccacaggaaugagccacaacaguggguguugcccucuuacuccggccggaacacacacaauguucaucucgccccggcuguggcgccuaccuuuccaggggaacagcuguuauucuuucguagcacuaugcccggauguucgggcuauccuaacauggaucuggacugccuccuuccccaggaguggguacaauacuucuaucaggaggcagccccagcucagucugaugucgcccuguugcgcuuugugaauccugacacggguagaguucuauucgaauguaagcugcacaaauccggguacgugacagucgcacauaccggccagcacgaucucgugauucccccaaacggauauuuuagguucgacucaugguga

SEQ ID NO: 21792 - RNA, 1563 nt, Artificial Sequence
  derived and/or modified sequence opt3 from VP1__Norovirus_and/or_Norovirus-like__KU687027
augaagauggccagcaacgacgcuaaucccuccgauggcucugcagccaaccuggugccugaggucaauaacgaaguuauggcgcucgagccagugguaggggcugccaucgcagcccuuguggcuggacagcaaaaugucauugacccguggauaagaaacaauuucgugcaggcacccgguggcgaauuuaccguuucaccuaggaacgccccaggggagauccuguggagugcucccuugggaccugauuuaaauccauaccugagccaccuagcccggauguauaacggcuacgcggguggguucgaagugcaggucauucucgcaggaaaugccuuuacagcuggcaaagugaucuucgccgcaguacccccuaacuuuccaacugagggccuguccccgucucagguuacgauguucccccauauuguggucgacgugcgccaacuugagccugugcugaucccauugcccgauguccgaaauaacuuuuaucacuacaaucagucgaacgacccuaccauaaagcucaucgcuaugcuguauacaccacugcgugccaacaaugcgggggaagauguuuucacugugucaugcagaguacucaccaggcccagcccggacuuugauuucaucuuuuuagugccucccacagucgagagucggaccaaaccauucuccgugccuguucugacuguggaagagaugacaaacucucgcuuucccauuccacuugagaaguuguucaccggacccagcuccgccuucgucgugcagccucagaaugguagauguacgacugacggcguacugcuagggaccauucaacucucaccaguuaacaucugcacauuuaggggagaugugacucauauaaccggcagucggaauuacacaaugaaccuggcaagccagaauuggaacgacuaugauccgaccgaagagauucccgcuccucuugguacgccagacuucgucgggaaaauccagggaaugcugacucagacaacccgcacugacggcucuacacgaggccacaaggccaccguguacacgggguccgcugauuuugcccccaaguugggaagaguccaauucgaaaccgacacagaucaugacuuugaggcaaaucagaacacuaaauucaccccuguggguguuauucaggauggcucaacaacucacaggaaugaaccacaacagugggugcuccccagcuacagugggcggaacaccccgaauguacaccuggccccugcugucgcgccaacauuucccggagagcaguuacuguucuuucguucuaccacuccuggcuguuccgguuaucccaacauggaccucgauugccuucugccacaggagugggugcaauacuucuaucaggaagcagccccugcucagagcgacguugccuugcuacgcuuugugaaucccgauacggggagaguccuguucgaguguaagcuccauaaaucgggcuacgugacaguagcacacaccggacagcaugaccuggugaucccaccgaacggcuauuuuagguucgaaucuugguga

SEQ ID NO: 21793 - RNA, 1563 nt, Artificial Sequence
  derived and/or modified sequence opt3 from VP1__Norovirus_and/or_Norovirus-like__KX764835
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccaccccgugccaacaaugcgggggaugacguguucacugucagcugcagaguucugaccaggccgaguccugauuuugacuucauuuuucuggugcccccaacaguagaaucccggaccaaaccuuucucugugcccguccucacuguggaggaaaugacaaacagccgcuuuccaauccccuuagagaagcuguucaccggaccuuccucagccuucguugugcagccacagaaugguagauguacgacugauggcguccuuuuggggaccacacaacugaguccggugaacauaugcacuuuuaggggagacguaacccauauuacaggcagccggaauuacaccaugaaccuagcaucucagaauuggaacaauuaugaucccacggaggaaaucccugcuccacucgguacucccgacuucguugggaaaauucagggaaugcugacacagaccacucgcacagacggcuccacccgaggccacaaggccacgguguacaccgggucagcugauuuugccccuaaacuuggaagaguccaauucgagacagacacugaucaugacuuugaagcaaaccagaauaccaaguucacaccagugggugucauccaggauggcagcacuacccacaggaacgagccccaacagugggugcugccgaguuacucugggcggaauacacacaacguucauuuggccccugcuguggcgccaaccuuucccggagaacagcuccuguucuuucguuccacuaugccuggcuguagcgguuaucccaauauggacuuagauugccugcucccacaggaguggguacaauacuucuaucaggaggcagccccugcucagucggacgucgcccuucugcgcuuugugaaccccgauacggggagaguuuuguucgaauguaaguuucacaaaucuggcuacgugacagucgcacauaccggacagcacgaccuagugaucccaccgaacggcuauuucagguucgaguccugguga

SEQ ID NO: 21794 - RNA, 1563 nt, Artificial Sequence
  derived and/or modified sequence opt3 from VP1__Norovirus_and/or_Norovirus-like__KX764832
augaagauggccagcaacgacgugaaucccuccgauggcucugcugcaaaccuggucccugagguuaauaacgaagugauggcccucgagccaguagugggggcggcuaucgccgcaccggucgccggacagcaaaaugugaucgaccccuggauaagaaacaauuucguucaggcuccugguggcgaauuuaccgugucaccaaggaacgcacccggggagauccuuuggagugccccucugggaccagauuugaaucccuacuuaagccaccuggcucggauguauaacggcuacgccgguggguucgaaguccaggugauucuagcgggaaaugcauuuacagccggcaaaaucauuuucgcugccguaccuccaaacuuuccgacugagggccucucccccucucagguuacgauguucccucauaucauaguggacguccgccaacuggagccagugcuuaucccccugccugaugugcgaaauaacuuuuaucacuacaaucagucgaacgacucaaccauuaaguugaucgcaaugcucuauacaccacugcgugcuaacaaugccggggaugacgucuucacuguuagcugcagagugcugaccaggcccaguccggauuuugacuucauuuuucucguaccucccacaguggaaucccggaccaaaccauucucugucccuguguuaacuguugaggaaaugacaaacagccgcuuucccaucccacuggagaaacuuuucaccggacccuccucagcguucgugguccagccucagaaugguagauguacgacugauggcguguugcuggggaccacacaacuaaguccaguaaacauaugcacuuuuaggggagacguuacccauauuacaggcagccggaauuacaccaugaaccucgccucucagaauuggaacaauuaugauccgacggaggaaauccccgcaccucuggguacuccagacuucguggggaagauucagggaaugcuuacacagaccacucgcacagacggcuccacccgaggccacaaggcuacggucuacaccgggucagccgauuuugcucccaagcugggaagagugcaauucgagacagacacugaucaugacuuugaagccaaccagaauaccaaauucacaccugucggugugauccaggauggcagcacuacccacaggaacgagccacaacagugggcauugcccaguuacucugggcggaauacacacaacguucaucucgccccggcuguggcgccuaccuuuccaggagaacagcuguuauucuuucguuccacuaugcccggcuguagcgguuauccuaauauggaccuggauugccuccuuccccaggaguggguacaauacuucuaucaggaggcagccccagcucagucggacgucgcccuguugcgcuuugugaacccuaacacggggagaguucuauucgaauguaagcugcacaaaucuggccaugugacagucgcacacaccggacagcacgaucucgugauucccccaaauggcuacuuuagguucgacuccugguga

SEQ ID NO: 21795 - RNA, 1563 nt, Artificial Sequence
  derived and/or modified sequence opt3 from VP1__Norovirus_and/or_Norovirus-like__KU687025
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucgugcuagcaggaaaugccuuuacagcuggcaaaguaauuuucgccgcaguuccuccaaacuuuccgacugaggaccucucccccucucaggugacgauguucccucauaucgucguggaugugcgccaacuggagccaguccuuauuccccugccugacguucgaaauaacuuuuaucacuacaaucagucgaacgauccaaccaucaaguugauagcuaugcucuauacaccccugcgugccaacaaugcgggcgaagacguguucacuguaucaugcagagugcugaccaggccgagcccugauuuugacuucaucuuucucgugcccccaacagucgagagucggaccaaaccuuucuccguucccguguuaacugucgaagagaugacaaacucucgcuuuccaauuccccuggagaaacuuuucaccgggccuagcuccgccuucgugguacagccacagaauggaagauguacgacugaugguguuuugcugggcaccauccaacuaucaccggugaacauuugcacauuuaggggagacgucacucauaucaccgggagucggaauuacacaaugaaccucgcaagccagaauuggaacaauuaugaucccaccgaagagauaccugcuccacugggcacgcccgacuucguggguaagauucaggggaugcuuacucagacaacccgcacugacggaucuacacgaggccacaaggccaccgucuacacgggcuccgcugauuuugccccuaagcuggggagagcacaauucgaaaccgacacagaucaugacuuugaggccaaccagaauacuaaauucaccccagugggaguuauccaggaugguucaacaacucacaggaacgaaccccaacaguggguguugccgagcuacaguggccggaauaccccuaacguacaccucgcuccagcggucgcacccacauuuccuggggagcagcuguuauucuuucguucuaccacucccggauguuccggcuauccaaauauggaccuggauugccuccuuccucaggagugggugcaauacuucuaucaggaagccgcucccgcccagagcgacguugcacuguugcgcuuugugaacccagauacggguagaguccuauucgaguguaagcugcauaaaucgggguacgugacaguagcccacgcuggccagcaugaccucgugauuccgccuaacggauauuuuagguucgaagccugguga

SEQ ID NO: 21796 - RNA, 1563 nt, Artificial Sequence
  derived and/or modified sequence opt3 from VP1__Norovirus_and/or_Norovirus-like__KU687026
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaagauguuuucacugugagcugcaaaguacugaccagaccgaguccugacuuugauuucauuuuucucgugcccccaacagucgaguccaggaccaagccuuucucugugcccguuuuaacuguggaagagaugacaaauagccgguuuccaaucccccuggagaaacuuuucaccggaccuuccucagccuucgucgugcagccacagaacggucgcuguacgacugacggcguauugcuggggaccauucaacuaaguccgguuaauaucugcacauuuagaggagaugugacucauauaaccggcagcaggaacuacacaaugaaucucgcaucucagaacuggaauaacugugaccccaccgaagagauuccugcuccacuggguacgcccgauuucgucgggaagauccagggaaugcuuacucagacaacccggacugacggcuccacacgcggccacaaggccaccguguauacggggucagcugacuuugccccuaaacugggacgaguccaauucgaaaccgauacagaccaugauuuugaggcaaaucagaacacuaaguucaccccaguggguguuauucaggacggcagcacaacucacagaaaugaaccccaacaguggguguugccgaguuacucugggaggaacaccccuaauguacaccucgccccagcugucgcgcccacauuuccuggagagcagcuguuauucuuucgguccaccacucccggcugcagcgguuacccaaacauggaucuggacugucuccuuccucaggagugggugcaauauuucuaccaggaagcagcccccgcucagucggauguugcccuguugcguuuugugaauccagacacggggcgcguccuauucgagugcaaacugcauaagucuggcuaugugacaguagcacacaccggacagcaugaucucgugaucccgccuaacggcuacuuuagauucgacgccugguga

SEQ ID NO: 21797 - RNA, 1563 nt, Artificial Sequence
  derived and/or modified sequence opt3 from VP1__Norovirus_and/or_Norovirus-like__KU687028
augaagauggccagcaacgacgcuaaucccuccgauggcucugcagccaaccuggugccugaggucaauaacgaaguuauggcgcucgagccagcugugggggccgcaaucgccgcuccgguagcaggacagcaaaaugugauugaccccuggauaagaaacaauuucguccaggccccugguggcgaauuuaccgugucaccaaggaacgcucccggggagauccuuuggagugccccucugggaccagauuugaaucccuacuuaagccaccuggcgcggauguauaacggcuacgccgguggguucgaaguucaggugauucuagcaggaaaugcuuuugccgcaggcaaagucaucuucgcugccgugccuccaaacuuuccgacagagggccucucccccucucagguaacuauguucccucauauuguuguggacguccgccaacuggagccagugcuuaucccccugccugaugugcgaaauaacuuuuaucacuacaaucagucgaacgacccaacgauaaaguugaucgcgaugcucuauacaccccugcgugccaacaaugcaggggaagaugucuucaccguuucaugcagagugcugacuaggccgagcccugacuuugauuucauuuuucucguacccccaaccguggagagucggacaaaaccuuucuccguccccguguuaaccguugaagagaugacuaacucucgcuuuccaaucccccuggagaaacuuuucacaggaccuagcuccgcuuucgugguccagccacagaaugguagauguaccacggacggcguguugcuggggacuauucaacuaucaccgguaaacaucugcaccuuuaggggagauguuacacauauaacuggcagucggaauuacaccaugaaccucgccagccagaauuggaacaauuaugaccccacagaagagauuccugcuccacuggguacccccgauuucguggggaagauccagggaaugcuuacgcagacuacacgcaccgacggcucuacucgaggccacaaggccacagucuacaccggguccgcagacuuugccccuaagcugggaagagugcaauucgaaacggauaccgaccaugauuuugaggcuaaccagaauacaaaauucacuccagucggugugauucaggacggcucaaccacacacaggaacgaaccccaacaguggguuuugccgagcuacagugggcggaauacuccuaacgugcaccucgcgccagcaguacccccuaccuuucccggagagcagcuguuauucuuucguucuacaaccccaggcuguuccgguuauccuaauauggaucuggacugccuccuuccccaggaguggguccaauacuucuaucaggaagccgcuccagcccagagcgauguggcacuguugcgcuuuguuaacccggacacugggagagugcuauucgaguguaagcugcauaaaucgggcuacgucacgguggcccacacaggacagcaugaucucguaaucccucccaacggcuauuuuagguucgaaucuugguga

SEQ ID NO: 21798 - RNA, 1563 nt, Artificial Sequence
  derived and/or modified sequence opt3 from VP1__Norovirus_and/or_Norovirus-like__KX764831
augaagauggccagcuccgacgugaaccccucugauggcucagcugcaaaucuggucccugagguuaacaaugaagugauggcccucgagccaguagugggggcggcuaucgccgcaccggucgccggacagcaaaacgugauugaccccuggauaagaaauaacuucguucaggcuccugguggcgaauuuaccgugaguccaaggaaugcacccggggagauccuuuggagcgccccucugggaccagauuugaaccccuacuuaucccaccuggcucggauguauaauggcuacgccgguggguucgaaguccaggugauucuagcgggaaacgcauuuacagccggcaaaaucauuuucgcugccguaccuccaaauuuuccgacuggcgggcucucucccucgcagguuacgauguucccucauaucauaguggacguccgccaacuggagccagugcuuaucccccugccugaugugcgaaacaauuuuuaucacuacaaccagucaaaugacagcaccauuaaguugaucgcaaugcucuauacaccacugcgugcuaacaacgccggagaugacgucuucacuguuaguugcagagugcugaccaggcccuccccggauuuugacuucauuuuucucguaccucccacaguggagucucggaccaaaccauucagcgucccuguguuaacuguugaagagaugacaaauucccgcuuucccaucccacuggaaaaacuuuucaccggucccucaagugcguucgugguccagccucagaacggcagauguacgacugaugggguguugcugggaaccacacaacuaagcccaguaaauauaugcacuuuuaggggcgacguuacccauauuacagguucucggaacuacaccaugaaucucgccucccagaacuggaauaacuaugauccgacggaggagauccccgcaccucuggggacuccagacuucgugggaaagauucagggcaugcuuacacagaccacucgcacagacggccccacccgagggcacaaggcuacggucuacaccggaucagccgauuuugcuccuaagcuggguagagugcaauucgaaacagacacugaucaugacuuugaggccaaucagaacaccaaauucacaccagucggcgugauccaggaugggagcacuacccacaggaaugaaccccaacaguggguuuugccgaguuacucuggacggaacacacacaaugugcaucucgccccugcaguagcuccaaccuuucccggcgagcagcuguuauucuuucguuccacuaugccugguuguagcggguaucccaacauggaccuggauugccuccuuccacaggaauggguccaauacuucuaucaggaggcggccccugcacagucggacguggcucuguugcgcuuuguuaaucccgauacgggcagagugcuauucgaguguaagcugcacaaaucuggauacgucacaguggcccauaccggccagcacgaccucguaaucccaccgaacggguauuuuagguucgaagcaugguga

SEQ ID NO: 21799 - RNA, 1560 nt, Artificial Sequence
  derived and/or modified sequence opt3 from VP1__Norovirus_and/or_Norovirus-like__JN222366
augaugauggccagcaaggacgcucccaccuccccugauggcgcaucuggggccggacagcuggugccagaggcgaacacagcugaacaaaucucaauggacccggucgccggugcaaguacugccguugcuacggcaggccaggugaauaugauugaucccuggauauucaacaauuuuguacaggccccucagggggaguucaccaucagcccaaacaauacacccggagacauucucuuugaucuucaacugggcccucacuugaacccauucuuagcucaucugucccagauguacaaugguuggguggggaacaugagagucaggauccuacucgccggaaaugcguuuacugcaggcaaaauuaucauaugcugugugcccccuggcuucgacgcccggauccugaccauugcucaggccacacuuuuuccacaccugaucgcagauguucgcaccuuggaaccgguggagcucccccuggaagacguccgaaacgugcuguaucauaauucuucgcagccucaaccaacuaugcgucucguagcuauguuauacacaccccugagaaccgggggagguucaggcgggacggaugccuucguuguggcgggaaggguccuuacuugcccugccccagacuuuagcuucuuguuucuggugcccccgaguguggagcagaagacccgggucuucuccguuccuaacauuccccuaaaagaucucucuaauagccgcgugccaguaccuauccagggcauguuuaugucccccgacgugaaccagucaguccaauuccagaaugguagaugucagauagaugggcaacugcagggaacaacuccagugagucuuagccagcugugcaagauuaggggcaaaaccucuuccaacgcacggguuuugaaccucucagagguggacggcacacccuucaucccucuggaaagcccagcuccggucggguuucccgacuuaggagguugugauuggcacgugaauuucaccuuucaggcccaaaaccaggacccuagucagucuguaacguucgcuacuaaugaugccuccuuuguuccauaucugggcagcauuucgccccauaacgggggagacuuccacgcaggcgauaucaucgguucucucggguggauuuccgccccuucagacaauagucagcuuaacguguggacaauaccaaaguacggcagcucccugcccgaugucacccacuuggcuccggcgguguuuccuccaggauucggcgaggucauccuauauuuuuacucuacuuuccccgggagcggacaaccuucacagcuccaggugcccugccugcugccacaggaauuuauuacacauuucuguaaugagcaagcaccuaucgccggugaggcugcccuucugcacuauguugaccccgauaccggccgcaacuugggggaauuuaagcucuacccagacggauucaugacgugcgugccgaauaguguauccagcggcccucagacccugcccauaaacggugucuucguguuuguuucuugggugucacgauga

SEQ ID NO: 21800 - RNA, 1557 nt, Artificial Sequence
  derived and/or modified sequence opt3 from VP1__Norovirus_and/or_Norovirus-like__KM386679
augaagauggccagcaacgacgcuacccccuccaaugauggcgcagccgggcuggugccugagucuaacaaugaagcgauggcucucgagccagucguuggagccucacuugcagccccggugacaggucagacuaacaucauugaccccuggauaagaacgaauuucguacaagcuccuaacggcgaauuuaccgugaguccaaggaauagccccggggagauccuggucaacuuggaauuaggaccugagcugaauccauaccuagcacaccucgcccggauguauaacggcuacgcuggugggauggaggugcagguuaugcuggccggaaaugcguucacagcaggcaaaauuaucuuugccgcugugcccccuuauuucccagucgaaaaccuuuccccgucucagauuacuauguuuccccaugugaucauagauguacgcacccuggagccuguuuugcucccaaugcccgacgugcgaucgacacuguuccacuuuaaucagaaggaugaaccuaaaaugcgucuggucgccaugcucuacaccccauuaagaucaaacggcagcggggacgauguguucacugugaguugcaggauccugacacggcccuccccggaguuugacuucaccuaucuugucccucccacgguugagucuaagacuaaaccauuuaccuugccugugcugacacuaggagaacucagcaauucccgcuucccccugucaauugaugagaugguaacuagcccaaacgaaagcaucgugguccaaccccagaacgguagagugacccuugacggcgagcuguuggggacaacccagcuccaggcauguaauauuugcucuaucaggggaaagguuacgggccaagugccuaacgaacagcauauguggaaucuggagauaacuaacuuaaaugguacacaguuugauccaaccgacgaugucccggcuccccugggggugccugacuucgccggagagguauucggcguucucucccagcggaaccgcggcgaaucaaauccagcgaaccgagcccacgacgcaguggucgcuacuuacagcgauaaguauacacccaaacuugggcuggugcaaauuggaaccuggaauacgaacgacgucgagaaucagccuaccaaguuuacaccaaucgguuugaacgaaguggccaauggccauagauucgagcaguggacucuacccagguacaguggggcucugacccucaacaugaaucuggccccggcaguugccccucuuuuuccaggagaacggcuguuguucuuucguucuuacgugccccucaaaggcgguuucgggaacccugcuauugauugucugguaccccaagaguggguccagcacuuuuaucaggaguccgcgccaaguuuaggcgacguggcacugguucgcuacgugaacccugauacaggaagaguccuauucgaagccaagcuccacaaaggcggguuucugacugugucgucuaccuccacaggacccguagugguuccagcuaaugguuauuucagguuugacuga

SEQ ID NO: 21801 - RNA, 1551 nt, Artificial Sequence
  derived and/or modified sequence opt3 from VP1__Norovirus_and/or_Norovirus-like__AY549156
augaagaugaccgacagagauacaguggacagcgcccccgcucugggccagguccucccuccagagguugaagcauccgugccgguagagcccacugccggggcgccuguggcugccccaacggcaggacaagucaaccccaucgauccuuggauuuucgccaauuuugugcaggcuccacagggugaguucaccauaucucccaacaauaacccuggcgaaauccuuuuugaacuggaguuggggccagacuuaaauccguaccuggcacaccuaaggcggauguauaacggauggacaggcucaaugcgcguucgagugcuccuggccgguaaugcuuucagugccgggaaagucgugguauuuugcguucccccuggauucgauacuagcuaccuuaccccaucccaggcgacacaauuuccccaugugcugauugacguccgugcaccugagccaguggaaaugcccuuggaggaugugagaaacauccucuuccaccagggcccggacucuaggaugcggcugaugggcaugcuguauaccccucuccgcgccaauucgggggcugaucccuuugucguuacuggaagaguguuaacauguccaucaccuaacuucagcuuuuucuuucugguacccccaaccguggaagagagggagcccccuuucacgcuuccaaauuugccggucaacaaucugagucauucccgggugauggaacccauugcccagaugaugucuagccgcaacuucccugcauccguucaguuucaaaauggucgaugcacucuaucaggcgaccuccuggggaccacaccaaguagccccgcugaucuuggagccuucgugggccugagagcggagccugguucuagggucguggaauugucccagccaaaccaggaggacuuucacgccgggucagcacccgcuccguucggauuuccugauuucagcgacuguaguguaacuuuuguuguggccucugcuaccacagucggcgaacggaccgugaacacgcguucccuccagaauuucacuccagcccugggccauaucacauuugacgaggaggcacccgccgauuuauuccgcgcucacuuuagaaaccugugggaaccuaccgagcacagcuucuggaggauacccgacuaccgggcggauguccucgggucggacuuugcaccaucuguguccgccccuggaguuggugaaacucuucuguucuucaugugcaaugugccccgauugaacggcgcuaauccaaacccguguccuugccuacugccccaagaguggaucacacauuuuguaucagaacgcgccgcacuccagagugaugucgcccugcuuaauuaugugaacccaaauaccgggagaguucuguucgaggcuaaguuguacgccaacggauuucucacggugaaucugggcgcacccgaccaggcgaccuuaccugucgaugguauuuucaaauuugugagcuggguauccucuuauuaccaacugaggccaguggggaacgcuagcgccggccggcgccuauga

SEQ ID NO: 21802 - RNA, 1551 nt, Artificial Sequence
  derived and/or modified sequence opt3 from VP1__Norovirus_and/or_Norovirus-like__AY549163
augaagaugaccgacagagauacaaucgacagcgcccccgcucugggccaggugcucccuccagaggucgaagcauccguuccgguggagcccacugccggggcgccuguagcugccccaacggcaggacaagugaaccccauugauccuuggauauucgccaauuuuguccaggcuccacagggugaguucaccaucucucccaacaauaacccuggcgaaauucuuuuugaacuggaguuggggccagacuuaaauccguaccuggcacaccuaaggcggauguauaacggauggacaggcucaaugcgcgugcgaguucuccuggccgguaaugcuuucagugccgggaaaguggucguguuuugcguacccccuggauucgauacuagcuaccuuaccccaucccaggcgacacaauuuccccauguucugaucgacgugcgugcaccugagccagucgaaaugcccuuggaggaugugagaaacauucucuuccaccagggcccggacucuaggaugcggcugaugggcaugcuguauaccccucuccgcgccaauuacggggcugaucccuuuguggucacuggaagaguuuuaacauguccaucgccuaacuucucauuuuucuuucuggugcccccaaccguagaagagagggagacgcccuucacucuuccuaauuugccagugaacaaucugagccauagucgggucauggaaccgaucgcccagaugauguccucucgcaacuuccccgcaagcgugcaguuucaaaauggucgaugcacccuauccggcgaccuccuggggacaacuccuucaaguccagcugaucuuggagccuucguuggccugagagcggagcccgguagcaggguggucgaauugucucagccuaaccaggaggacuuucacgccggguccgcaccagcucccuucggauuuccggauuucucagacuguagcgugaccuuuguaguugccagugcuacaaccgugggcgaacggacggucaacacucguucucuccagaauuucaccccugcccugggccauauaacauuugacgaggaggcaccagccgauuuauuccgcgcucacuuuagaaaccugugggaacccacugagcacuccuucuggaggaucccugacuaucgggcggaugugcucgggagcgacuuugcacccucggucucugccccaggagugggugaaacacuucuguucuucaugugcaauguuccucgauugaacggcgcuaaucccaacccauguccgugccuacugccucaagaguggauuacccauuuuguguccgaacgcgccgcacuccagucagauguagcccugcuuaauuacgucaaccccaauacggggagagugcuguucgaggcuaaguuguaugccaacggauuucucaccguuaaucugggcgcaagugaccaggcgaucuuaccaguggaugguauuuucaaauuugucagcuggguguccuucuacuaccaacugaggcccguagggaacgcuucugugggccggcgccuauga

SEQ ID NO: 21803 - RNA, 1551 nt, Artificial Sequence
  derived and/or modified sequence opt3 from VP1__Norovirus_and/or_Norovirus-like__AY549159
augaagaugaccgacagagauacaguggacagcgcccccgcucugggccagguccucccuccagagguugaagcauccgugccgguagagcccacugccggggcgccuguggcugccccaacggcaggacaagucaaccccaucgauccuuggauuuucgccaauuuugugcaggcuccacagggugaguucaccauaucucccaacaauaacccuggcgaaauccuuuuugaacuggaguuggggccagacuuaaauccguaccuggcacaccuaaggcggauguauaacggauggacaggcucaaugcgcguucgagugcuccuggccgguaaugcuuucagugccgggaaagucgugguauuuugcguucccccuggauucgauacuagcuaccuuaccccaucccaggcgacacaauuuccccaugugcugauugacguccgugcaccugagccaguggaaaugcccuuggaggaugugagaaacauccucuuccaccagggcccggacucuaggaugcggcugaugggcaugcuguauaccccucuccgcgccaauucgggggcugaucccuuugucguuacuggaagaguguuaacauguccaucaccuaacuucagcuuuuucuuucugguacccccaaccguggaagagagggagacgcccuucacucuuccuaauuugccagucaacaaucugagucauucccgggugauggaaccgauugcccagaugaugucuagccgcaacuuccccgcauccguucaguuucaaaauggucgaugcacccuaucaggcgaccuccuggggacaacuccuaguagcccagcugaucuuggagccuucgugggccugagagcggagcccgguucuagggucguggaauugucccagccuaaccaggaggacuuucacgccgggucagcaccagcucccuucggauuuccggauuucagcgacuguaguguaaccuuuguuguggccucugcuacaaccgucggcgaacggacggugaacgcccguucccuccagaauuucacuccugcacugggccauaucacauuugacgaggaggccccagcugauuuauuccgcgcgcaccugagaaaccucugggaacccaccgagcacagcuuuuggaggauaccugacuaccgggcagauguccuugggucggacuucgcccccucuguguccgcuccaggaguuggugaaacucuguuguuuuucaugugcaaugugccucgacuaaacggcgccaaucccaacccauguccgugccugcucccucaagaguggaucacacauuucguaucagaacgcgcagcccugcagagugaugucgcccuucugaauuaugugagccccaacaccgggagaguuuuguuugaggcuaagcucuacgcaaauggauuccugacggugaacuuaggcgcguccgaccaggcuacccugccagucgaugguauuuuuaaauucgugucuugggugagcuuuuauuaccaacuaaggcccguagggaaugccucaguuggccggcgccucuga

SEQ ID NO: 21804 - RNA, 1551 nt, Artificial Sequence
  derived and/or modified sequence opt3 from VP1__Norovirus_and/or_Norovirus-like__AY549166
augaagaugaccgacagagauacaguggacagcgcccccgcucugggccagguccucccuccagagguugaagcauccgugccgguagagcccacugccggggcgccuguggcugccccaacggcaggacaagucaaccccaucgauccuuggauuuucgccaauuuugugcaggcuccacagggugaguucaccauaucucccaacaauaacccuggcgaaauccuuuuugaacuggaguuggggccagacuuaaauccguaccuggcacaccuaaggcggauguauaacggauggacaggcucaaugcgcguucgagugcuccuggccgguaaugcuuucagugccgggaaagucgugguauuuugcguucccccuggauucgauacuagcuaccuuaccccaucccaggcgacacaauuuccccaugugcugauugacguccgugcaccugagccaguggaaaugcccuuggaggaugugagaaacauccucuuccaccagggcccggacucuaggaugcggcugaugggcaugcuguauaccccucuccgcgccaauucgggggcugaucccuuugucguuacuggaagaguguuaacauguccaucaccuaacuucagcuuuuucuuucugguacccccaaccguggaagagagggagacgcccuucacucuuccuaauuugccagucaacaaucugagucauucccgggugauggaaccgauugcccagaugaugucuagccgcaacuuccccgcauccguucaguuucaaaauggucgaugcacccuaucaggcgaccuccuggggacaacuccuaguagcccagcugaucuuggagccuucgugggccugagagcggagcccgguucuagggucguggaauugucccagccuaaccaggaggacuuucacgccgggucagcaccagcucccuucggauuuccggauuucagcgacuguaguguaaccuuuguuguggccucugcuacaaccgucggcgaacggacggugaacacucguucccuccagaauuucaccccugcccugggccauaucacauuugacgaggaggcaccagccgauuuauuccgcgcucacuuuagaaaccugugggaacccacugagcacagcuucuggaggauaccugacuaccgggcggauguccucgggucggacuuugcacccucuguguccgccccaggaguuggugaaacacuucuguucuucaugugcaaugugccucgauugaacggcgcuaaucccaacccauguccgugccuacugccucaagaguggaucacccauuuuguaucagaacgcgccgcacuccagagugaugucgcccugcuuaauuaugugaaccccaauacggggagaguucuguuggaggcuaagcucugugccaacggauuccugaccgugaauuuaggcgcaagcgaccaggcgacacugccagucgaugguauuuuuaaauucguguccuggguaucuuuuuacuaucaacuaaggcccguggggaacgcuagcguuggccggcgccucuga

SEQ ID NO: 21805 - RNA, 1551 nt, Artificial Sequence
  derived and/or modified sequence opt3 from VP1__Norovirus_and/or_Norovirus-like__AF320113
augaagaugaccgacagagauaucauugacagcgcccccgcucugggccaggugcucccuccagaggucgaagcauccguuccgguggagcccacagccggggcgccuguagcugccccaacugcaggacaagugaaccccauagauccuuggaucuucgccaauuuuguccaggcuccacagggugaguucacgauuucucccaacaauaacccuggcgaaauccuuuuugaacuggaguuggggccagacuuaaauccguaccuggcacaccuaaggcggauguauaacggauggaccggcucaaugcgcgugcgaguucuccuggccgguaaugcuuucagugccgggaaaguggucguguuuugcguacccccuggauucgauacaagcuaccuuacuccaucccaggcgacccaauuuccccauguucugauugacgugcgugcaccugagccagucgaaaugcccuuggaggaugugagaaacauccucuuccaccagggcccggacucuaggaugcggcugaugggcaugcuguauacaccucuccgcgccaauucgggggcugaucccuuuguggucaccggaagaguuuuaccauguccuucacccaacuucagcuuuuucuuucuggugccacccacuguagaagagagggagccuccauucacacuuccgaauuugcccgugaacaaucugagucauucccgggucauggaaccuauagcccagaugaugucuagccgcaccuucccagcauccgugcaguuucaaaacggucgaugcacgcuaucaggcgaccuccuggggacuacccccaguagcccuucugaucuuggagcuuucguuggccugaucgccgagccagguuccagaguggucgaauuguuucagcccaaucaggaggacuuccacgcggggucagccccggcaccucucggauuuccagauuucagcgacuguagucugacauuugugguagcuucugccacuaccguuggcgaaaggacagugaacgcucgguccuuacagaacuucacccccgcccugggccauauuacguuugacgaggaggccccugcagaucucuuccgugcucaccuucgcaaucugugggaccccacugaacacagcuuuuggagaaucccagauuacagggcggacgucuuggggucggagcuagcaccuucuguguccgcccccggagucggugaaacacuccuguucuuuaccugcaacgugccacggcugaauggcgcuaacccgaauccuugucccugccuucugccacaagaguggauuacucauuucguuucagaacgagccgcauugcagagugauguggcccuccugaacuauguaaaucccaacacagggcgcgucuuauucgaggcuaagcuguacgugaauggauuucuaaccguuaaccucggcgccagcgaccaggcaacgcugccuguggaugguaucuucaaauuugucuccugggugucuuucuauuaccaacuuagaccaguagggaaugcgagcgugggcaggcgguuguga

SEQ ID NO: 21806 - RNA, 1551 nt, Artificial Sequence
  derived and/or modified sequence opt3 from VP1__Norovirus_and/or_Norovirus-like__AY549153
augaagaugaccgacagagauacaguggacagcgcccccgcucugggccagguccucccuccagagguugaagcauccgugccgguagagcccacugccggggcgccuguggcugccccaacggcaggacaagucaaccccaucgauccuuggauuuucgccaauuuugugcaggcuccacagggugaauuuaccauaucucccaacaauaacccuggcgagauccuuuuugaacuggaguuggggccagacuuaaauccguaccuggcacaccuaaggcggauguauaacggauggacaggcucaaugcgcguucgagugcuccuggccgguaaugcuuucagugccgggaaagucgugguauuuugcguucccccuggauucgauacuagcuaccuuaccccaucccaggcgacacaauuuccccaugugcugauugacguccgugcaccugagccaguggaaaugcccuuggaggaugugagaaacauccucuuccaccagggcccggacucuaggaugcggcugaugggcaugcuguauaccccucuccgcgccaauucgggggcugaucccuuugucguuacuggaagaguguuaacauguccaucaccuaacuucagcuuuuucuuucugguacccccaaccguggaagagagggagcccccuuucacgcuuccaaauuugccggucaacaaucugagucauucccgggugauggaacccauugcccagaugaugucuagccgcuccaguccugcaucaauccaguuccaaaacggucgaugcacucuaagcggcgaccuccuggggaccacaccaucuucccccgcugaucuuggagccuuuguuggccugagagcggagccugguucacacguggucgaauugagccagccaaaucaggaggacuuccaugccgggagugcacccgcuccguuuggauucccugauuuuucugacuguuccgugacuuucguaguugccagcgcuaccauaguggaacagaggacagucaacgcccggucgcuccaaaacuuuaccccagcacugggccacaucacguucgacgaggaggcccccgcugauuuauuucgugcgcgcuucagaaaugugugggacccuacugaacacucuuuuuggaggauucccgauuaccgggcagacguccugggcuccgauuucgccccaucagugagugcuccugggguuggagagacacuccuuuucuucaugugcaacgugccccauagcaauggugccaacccaaauccguguccuugccuguugccccaggaauggaucacccacuucguauccgagcgagcagcccuacagggcgacgucgcucugcucaacuauauuaauccaaacacugggcgcgugucuuuugaagccaagcuguacgcaaauggauuccuuacaguuaaccugggcgcgagcgauagaaccacguugcccguggacgguaucuuuaaauucgucucaugggugaguuuuuauuaccaacucaggccuguagggaaugcuuccgugggccggcgccuguga

SEQ ID NO: 21807 - RNA, 1551 nt, Artificial Sequence
  derived and/or modified sequence opt3 from VP1__Norovirus_and/or_Norovirus-like__AY549157
augaagaugaccgacagagauacaguggacagcgcccccgcucugggccagguccucccuccagagguugaagcauccgugccgguagagcccacugccggggcgccuguggcugccccaacggcaggacaagucaaccccaucgauccuuggauuuucgccaauuuugugcaggcuccacagggugaguucaccauaucucccaacaauaacccuggcgaaauccuuuuugaacuggaguuggggccagacuuaaauccguaccuggcacaccuaaggcggauguauaacggauggacaggcucaaugcgcguucgagugcuccuggccgguaaugcuuucagugccgggaaagucgugguauuuugcguucccccuggauucgauacuagcuaccuuaccccaucccaggcgacacaauuuccccaugugcugauugacguccgugcaccugagccaguggaaaugcccuuggaggaugugagaaacauccucuuccaccagggcccggacucuaggaugcggcugaugggcaugcuguauaccccucuccgcgccaauucgggggcugaucccuuugucguuacuggaagaguguuaacauguccaucaccuaacuucagcuuuuucuuucugguacccccaaccguggaagagagggagcccccuuucacgcuuccaaauuugccggucaacaaucugagucauucccgggugauggaacccauugcccagaugaugucuagccgcaacuucccugcauccguucaguuucaaaauggucgaagaacucuaucaggcgaccuccuggggaccacaccaaguagccccgcugaucuuggagccuucgugggccugagggcggagccugguucucgggucguggaauugucccagccaaaccaggaggacuuucacgccgggucagcacccgcuccguucggauuuccugauuucagcgacugcaguguaacuuuuguuguggccucugcuaccacagucggcgaacguaccgugaacacgcgcucccuccagaauuucacuccagcccugggccauaucacauuugacgaggaggcacccgccgauuuauucagagcucacuuuaggaaccugugggaaccuaccgagcacagcuucuggcggauacccgacuaccgagcggauguccucgggucggacuuugcaccaucuguguccgccccuggaguuggugaaacucuucuguucuucauguguaaugugccccgcuugaacggcgcuaauccaaacccgugcccuugucuacugccccaagaguggaucacacauuuuguaucagaaagagccgcacuccagagugaugucgcccugcuuaauuaugugaacccaaauaccgggaggguucuguucgaggcuaaguuguacgccaacggauuucucacggugaaucugggcgcaagcgaccaggcgaccuuacccgucgaugguauuuucaaauuuguguccuggguaucuuucuauuaccaacugcggccuguggggaacgcuagcguuggccgcagacuauga

SEQ ID NO: 21808 - RNA, 1551 nt, Artificial Sequence
  derived and/or modified sequence opt3 from VP1__Norovirus_and/or_Norovirus-like__AY549158
augaagaugaccgacagagaugccguggacagcgcucccgcacugggccagguccucccuccagagguugaagccuccgugccgguagagcccacagcgggggcuccuguggccgcaccaacugccggacaagucaaccccaucgauccuuggauuuucgcuaauuuugugcaggcaccacagggugaguucacgauaucucccaacaauaacccuggcgaaauccuuuuugaacuggaguuggggccagacuuaaauccguaccuggcccaccuaaggcggauguauaacggauggaccggcucaaugcgcguucgagugcuccuggcugguaaugccuucagugcggggaaagucgugguauuuugcguucccccuggauucgauacaagcuaccuuacuccaucccaggcaacccaauuuccccaugugcugauugacguccgugccccugagccaguggaaaugcccuuggaggaugugagaaacauccucuuccaccagggcccggacucuaggaugcggcugaugggcaugcuguauacaccucuccgcgcuaauucgggggccgaucccuuugucguuaccggaagaguguuaacuuguccaucaccuaacuucagcuuuuucuuucugguacccccaacaguggaagagagggagcccccuuucacccuuccaaauuugccggucaacaaucccagucauucccgggugauggaaccuauugcacagaugaugucuagccgcaacuucccagcuuccguucaguuucaaaauggucgaugcacgcugucaggcgaccuacucgggacuacccccaguagcccugccgaucugggagcguucgugggccuuagagccgagccagguucuagggucguggaacugucccagcccaaccaggaggacuuucacgcagggucagcuccggccccuuucggauuuccagauuucagcgacuguaguguaacauuuguuguggcuucugccacuaccgucggcgaacggacagugaacacccguuccuugcagaauuucacgcccgcacucggccauaucacuuuugacgaggaggccccugcugaucuguuccgcgcgcacuuuagaaacuuaugggaacccacagagcacagcuucuggaggauaccagacuaccgggcagauguccuggggucggacuuugccccuucuguguccgcucccggaguuggugaaacccuccuuuucuucaugugcaaugugccacgacugaacggcgccaauccgaacccuugucccugcuugcuaccacaagaguggaucacucauuuuguaucagaacgcgcagcccugcagagugaugucgcucuccugaauuaugugaaccccaauacagggagaguucuuuucgaggccaagcuguacgcaaacggcagcuugaccgugaaucucggagcguccgaccaggcuacgcugccugucgaugguauuuuuaaauucgugucuugggugagcuuuuauuaccaauuaaggccaguagggaacgccucaguuggccggcgccuguga

SEQ ID NO: 21809 - RNA, 1551 nt, Artificial Sequence
  derived and/or modified sequence opt3 from VP1__Norovirus_and/or_Norovirus-like__AY549165
augaagaugaccgacagagauacaguggacagcgcccccgcucugggccagguccucccuccagagguugaagcauccgugccgguagagcccacugccggggcgccuguggcugccccaacggcaggacaagucaaccccaucgauccuuggauuuucgccaauuuugugcaggcuccacagggugaguucaccauaucucccaacaauaacccuggcgaaauccuuuuugaacuggaguuggggccagacuuaaauccguaccuggcacaccuaaggcggauguauaacggauggacaggcucaaugcgcguucgagugcuccuggccgguaaugcuuucagugccgggaaagucgugguauuuugcguucccccuggauucgaugcgagcuaccuuacuccaucccaggcaacccaauuuccccaugugcugauugacguccgugccccugagccaguggaaaugcccuuggaggaugugagaaacauccucuuccaccagggcccggacucuaggaugcggcugaugggcaugcuguauacaccucuccgcgcuaauucgggggccgaucccuuugucguuaccggaagaguguuaacuuguccaucaccuaacuucagcuuuuucuuucugggucccccaacaguagaagagagggagccccuuuucaccuugccuaaucugccagugaacaaucuaagucauucccgggucauggaaccgauugcacagaugaugucuagccgcuccuuccccgcuucagugcaguuucaaaacggccgaugcacgcucaguggggaccugcuuggaacuaccccuagcucuccagccgaucugggcgcguucguugguuugagagccgagcccgggucccacguggucgaacucucacagccuaaucaggaggacuuucaugcaggaagcgcuccagcccccuucggcuuuccggauuucaguggcuguucugugacauuuguaguugcuuccgccacuaucguggaacagaggaccgucaacacacggagccugcaaaacuucaccccugcauuagggcacauaacguuugacgaggaggccccagcugaccuguuccgugcgcgcuuuagaaaugugugggaucccacugaacacucguucuggaggaucccugacuaccgggcagauguccucggaucugacuuugcccccuccgugucagcuccagguggcggggagacacuucuguucuucaugugcaacguuccucauaguaauggagccaaccccaauccauguccgugcuugcuaccucaggaauggauuacccacuuugugagcgagcgagcagcccugcagggcgauguagcucuccugaacuauaucaaucccaacacuggucgcguccuuuucgaagccaagcuguacgcaaauggguuuuugacagugaaccucggcgcguccgaccaagcugcccugccaguugauggaauuuucaaauuugugucuugggucagcuucuauuaccaguuaagacccgugggcaaugcaucaguagggaggcggcuguga

SEQ ID NO: 21810 - RNA, 1551 nt, Artificial Sequence
  derived and/or modified sequence opt3 from VP1__Norovirus_and/or_Norovirus-like__AY549167
augaagaugaccgacagagauacaguggacagcgcccccgcucugggccagguccucccuccagagguugaagcauccgugccgguagagcccacugccggggcgccuguggcugccccaacggcaggacaagucaaccccaucgauccuuggauuuucgccaauuuugugcaggcuccacagggugaguucaccauaucucccaacaauaacccuggcgaaauccuuuuugaacuggaguuggggccagacuuaaauccguaccuggcacaccuaaggcggauguauaacggauggacaggcucaaugcgcguucgagugcuccuggccgguaaugcuuucagugccgggaaagucgugguauuuugcguucccccuggauucgauacuagcuaccuuaccccaucccaggcgacacaauuuccccaugugcugauugacguccgugcaccugagccaguggaaaugcccuuggaggaugugagaaacauccucuuccaccagggcccggacucuaggaugcggcugaugggcaugcuguauaccccucuccgcgccaauucgggggcugaucccuuugucguuacuggaagaguguuaacauguccaucaccuaacuucagcuuuuucuuucugguacccccaaccguggaagagagggagccccuuuucacguugccuaaucugccagucaacaaucuaagucauucccgggugauggaaccgauugcccagaugaugucuagccgcgguuuccccgcauccguucaguuucaaaacggccgaugcacucucucaggggaccugcuuggaaccacaccuaguagcccagcugaucugggcgccuucguggguuugagagcggagcccgggucucacgucguggaacucucccagccuaaucaggaggacuuucaugccggaucagcaccagcucccuucggcuuuccggauuucagcgacuguaguguaacuuuuguuguggccucugcuaccaucgucgaacagaggacagugaacgcccggucccugcaaaacuucaccccugcauuaggccacauaacguuugacgaggaggccccagcugaucuguuccgugcgcgcuuuagaaaugucugggaccccacugaacacagcuucuggaggaucccugauuaccgggcagacgugcucgggucggauuuugcccccucuguuuccgcuccaggagugggugagacacuucuguucuucaugugcaacguaccucauucaaguggcgccaaucccaacccauguccgugcuugcuaccucaggaauggauuacccacuuugucagcgagcgagcagcccugcagggggacguggcucuccugaauuauaucaaccccaauacuggacgcguucuuuucgaagccaagcuguacgcaaacggcuuuuugacagugaaucucggugcguccgaucaagcuacccugccagucgacgggauuuucaaauuugugucuugggugagcuucuauuaccaguuaagacccguaggcaacgccucaguuggaaggcggcuguga

SEQ ID NO: 21811 - RNA, 1551 nt, Artificial Sequence
  derived and/or modified sequence opt3 from VP1__Norovirus_and/or_Norovirus-like__AY549154
augaagaugaccgacagagauacaguggaccccgccccugcucugggccagguccucccaccggagguugaagcaagcgugcccguagagccuacugccggggcgccaguggcugcccccacggcaggacaagucaacccuaucgauccauggauuuucgccaauuuugugcaggcuccccagggugaguucaccauauccccuaacaauaacccaggcgaaauccuuuuugaacuggaguuggggccggacuuaaaucccuaccuggcacaccuaaggcauauguauaacggauggacaggcucuaugcggguucgcgugcuccuggccgguaaugcuuucucagccgggaaagucgugguauuuugcguuccuccaggauucgauaccaguuaccuuacccccagccaggcgacacaauuuccucacgugcugauugacguccgagcaccagagcccguggaaaugccguuggaggaugugcguaacauccucuuccaucagggcccugacuccagaaugaggcugaugggcaugcuguauacuccccuccgggccaauucuucggcugauccauuugucguuacugggcgcguguuaacauguccuaaccccaauuucucauuuuucuuucugguaccacccaccguggaagagagagagccuccauucacgcuuccgaacuugcccgucaauaaccugagccacaguagggugauggaaccuauugcccagaugauguccucucggaauuucccagcaagcguucaguuucaaaacggacgcugcacucuauccggugaccuccugggcaccacacccucaaguccugcugaucuuggggccuucgugggacugcgagcggagccaggcagcagagucguggaauugucucagcccaaccaggaggacuuucaugccgguuccgcaccggcuccuuucggguuuccagauuucucagacuguagcguaacuuuuguuguggccagugcuaccacagucggagaaaggaccgugaauacgcggucucuccagaacuucacucccgcccugggccacaucacauuugacgaggaggccccugcagauuuauuccgugcucacuuucgcaaucugugggaacccaccgagcauuccuucuggagaauaccagacuacagggcggauguccucggcagcgacuuugcaccuucggugucugcccccgggguuggagaaacucuucuguucuucaugugcaacgugccacgguugaauggugcuaacccgaauccuugucccugccuacugccacaagaguggaucacacacuuuguauccgaacgagccgcacuccagucagaugucgcccugcuuaacuaugugaaucccaacaccggccgcguucuguucgaggcuaaguuguacgccaauggguuucucacggugaaccugggagcaagugaccaggcgaccuuaccugucgauggcauuuucaaauuugugagcuggguauccuucuauuaccaacugagaccaguggguaaugcuucuguugggaggcggcuauga

SEQ ID NO: 21812 - RNA, 1551 nt, Artificial Sequence
  derived and/or modified sequence opt3 from VP1__Norovirus_and/or_Norovirus-like__AY549155
augaagaugaccgacagagauacaguggacagcgcccccgcucugggccagguccucccuccagagguugaagcauccgugccgguagagcccacugccggggcgccuguggcugccccaacggcaggacaagucaaccccaucgauccuuggauuuucgccaauuuugugcaggcuccacagggugaauuuaccauaucucccaacaauaacccuggcgagauccuuuuugaacuggaguuggggccagacuuaaauccguaccuggcacaccuaaggcggguuuauaacggauggacaggcucaaugcgcgugcgaguccuccuggccgguaaugcuuucagugccgggaaagugguaguuuucugcgugcccccuggauucgauacuagcuaccuuaccccaucccaggcgacacaauuuccccauguccugauugacgugcgugcaccugagccaguggaaaugcccuuggaggaugucagaaacauccucuuccaccagggcccggacucuaggaugaagcugaugggcaugcuguauaccccucuccgggccaauucgucagcuaaccccuuuguugugacugggcgcguauuaacauguccaagcccuaauuucuccuuuuucuuucuggugcccccaaccgucgaagagagagagcccccuuucacgcuuccaaacuugccggugaauaaccugagucauucucagguuauggaacccauugcccagaugaugagcuccaggaauuucccugcaucagugcaauuucagaacggacggugcacucuaaguggugaucuccugggcaccacaccaagcucucccgcugaccuuggggccuucgucggacugcgcgcggagccuggcucccgagugguagaauugucacagccaaaccaggaggauuuucacgccgguagcgcacccgcuccguucggguuuccugacuucagugauuguucuguuacuuuuguggucgccuccgcuaccacagugggagaaagaaccgucaaugccaggacgcuccaaaacuucacuccagcacugggccauaucacauuugacgaggaggcccccgcugacuuauuccgggcgcacuuucguaaucugugggaaccuaccgagcacagcuucuggcgcauacccgauuacagagcagacgugcucggcucggauuuugccccaucuguuuccgcuccuggggugggagaaacucuucuguucuucaugugcaacguacccagguugaauggugccaacccaaauccguguccuugccuacugccccaggaguggaucacacauuuugucucagaacgggcagcccuccagagugacguggcucugcuuaacuauguuaauccaaacaccggccgagugcuguucgaggccaaauuguacgcaaauggguuucucacggucaaccugggagcgagcgaucaagcuaccuuacccguggacggcauuuucaaguuuguauccugggugucuuucuauuaccagcugcgcccuguugguaaugccagcgucgggagaaggcuauga

SEQ ID NO: 21813 - RNA, 1551 nt, Artificial Sequence
  derived and/or modified sequence opt3 from VP1__Norovirus_and/or_Norovirus-like__AF320625
augaagaugaccgacagagauaucauugacagcgcccccgcucugggccaggugcucccuccagaggucgaagcauccguuccgguggagcccacagccggggcgccuguagcugccccaacugcaggacaagugaaccccauagauccuuggaucuucgccaauuuuguccaggcuccacaggguguguucacgauuucucccaacaauaacccuggcgaaauccuuuuugagcuggaauuggggccagacuuaaauccguaccuggcacaccuaaggcggauguauaacggauggaccggcucaaugcgcguucgagugcuccuggccgguaaugcuuucagugccgggaaagucgugguauuuugcguucccccuggauucgauacaagcuaccuuacuccaucccaggcgacccaauuuccccaugugcugauugacguccgugcaccugagccaguggagaugcccuuggaagaugugagaaacauccucuuccaccagggcccggacucuaggaugcggcugaugggcaugcuguauacaccucuccgcgccaauucgggggcugaucccuuugucguuaccggaagaguguuaacuuguccaucaccuaacuucagcuuuuucuuucugguacccccaacaguggaggaaagggagcccaguuucacccuuccuaauuugccagucaacaaucugucccauucucgggugauggagccgauagcccagaugaugagcucccgcacguuccccgcaucaguucaguuucaaaacggucgaugcacucuaaguggcgaccuccuggggaccacaccuagcucuccauccgaucuuggagcuuucgugggccugaucgccgaacccgguucaagaauugucgaguugagccagccuaaucaggaagacuuucacgcggggagugccccagcacccuucggauuuccggauuucucugacuguucccucacuuuugugguagcuagcgccaccacaguuggcgagaggaccgugaacgcucggucgcugcagaacuucacgccugccuuaggccauaucacuuuugacgaagaggcaccagccgaucuguuccgugcucaccuccgcaaucuuugggaccccacagagcacucuuuuuggaggauuccugauuacagagcggacguccugggguccgaguucgcacccucagugagugccccaggagucggugaaaccuugcuauuuuucaugugcaacgugccucggcugaauggcgcuaaccccaauccauguccgugccuccugccucaagaauggaucacucauuucguuagcgagcgagccgcacuucaguccgauguggcccuguugaacuauguaaaucccaacacagggcgcguccucuuugaagcuaagcuguacgccaauggauucuuaaccgugaaccugggcgcaucugaccaggcgacgcuaccaguugaugguauauuuaaauucgugagcugggucucauuuuauuaccaacucagacccguggggaaugcuaguguaggcaggcggcuguga

SEQ ID NO: 21814 - RNA, 1551 nt, Artificial Sequence
  derived and/or modified sequence opt3 from VP1__Norovirus_and/or_Norovirus-like__AY274820
augaagaugaccgacagagauacaguggacagcgcccccgcucugggccagguccucccuccagagguugaagcauccgugccgguagagcccacugccggggcgccuguggcugccccaacggcaggacaagucaaccccaucgauccuuggauuuucgccaauuuugugcaggcuccacacggugaguucaccauaucucccaacaauaacccuggcgaaguucuuuuugaacugaaauuggggccagacuuaaauccguaccuggcacaucuaaggcggauguauaacggauggacaggcucaaugcgcgugcgaguccuccuggccgguaaugcuuucagugccgggaaggugguaguauuuugcgugcccccuggauucgauacuagcuaccuuaccccaucccaggcgacacaguuuccccacguccugaucgacgugcgugcaccuaaaccaguggagaugcccuuggaggaugucagaaacauucucuuccaucaaggcccggacucuaggaugcggcugaugggcaugcuguauaccccucuccgcgccaauucgggggcugaucccuuuguugugacuggaagaguauuaacauguccaucaccuaacuucagcuuuuucuuucuggugcccccaaccgucgaagagagggaacccccuuucacgcuuccaaauuugccggugaacaaucugagucacucccggguuauggagcccaucgcccagaugaugucuagccgcaacuucccugcauccgugcaguuucagaauggucgaugcacucuaucaggcgaccuccuggggaccacaccaaguagccccgcugaucuuggagccuucgucggccugagagcggagccugguucuagggugguagaauugucccaaccaaaccaggaggacuuucaugccgggucagcacccgcuccguucggauuuccugauuucagcgaauguaguguuacuuuuaugguggccucugcuaccacagucggcgagcggaccgugaacacgcguucccuccagaauuucacuccagcccugggccacauuacauuugacgaagaggcacccgccgacuuauuccgcgcuagauuuaggaaccugugggagccuaccgaacacagcuucuggcggauccccgauuaccgagcggacguccucgggucggaguuugcaccaucuguguccgccccuggaguuggugaaacucuucuguucuucaugugcaaugugccccgcuugaacggcgcuaauccaaacccguguccuugccuacugccccaggaguggauaacacauuuuguaucagaaagagccgcacuccaaagugaugucgcccugcuuaauuaugugaacccaaauaccgggaggguucuguucgaggcuaaguuguacgccaacggauuucucacggugaaucugggcgcaagcgaccaggcguccuuacccgucgaugguaucuucaaauuugugucuuggguuagcuucuauuaccagcugcggccuguggggaacgcuucaguuggccgcagacuauga

SEQ ID NO: 21815 - RNA, 1551 nt, Artificial Sequence
  derived and/or modified sequence opt3 from VP1__Norovirus_and/or_Norovirus-like__AF542083
augaagaugaccgacagagauacaguggacagcgcccccgcucugggccagguccucccuccagagguugaagcauccgugccgguagagcccacugccggggcgccuguggcugccccaacggcaggacaagucaaccccaucgauccuuggauuuucgccaauuuugugcaggcuccacagggugaauuuaccauaucucccaacaauaacccuggcgagguucuuuuugaacuggaguuggggccagacuuaaauccguaccuggcacaccuaaggcggauguauaacggauggacaggcucaaugcgcgugcgaguccuccuggccgguaaugcuuucagugccgggaaagugguaguuuucugcgugcccccuggauucgauacuagcuaccuuaccccaucccaggcgacacaauuuccccauguccugaucgacgugcgugcaccugagccaguggaaaugcccuuggaggaugucagaaacauucucuuccaccagggcccggacucuaggaugcggcugaugggcaugcuguauaccccucuccgcgccaauucgggggcugaucccuuuguugugacuggaagaguauuaacauguccaucaccuaacuucagcuuuuucuuucuggugcccccaaccgucgaagagagggagcccccuuucacgcuuccaaauuugccggugaacaaucugagucauucccggguuauggaacccaucgcccagaugaugucuagccgcaacuucccugcauccgugcaguuucaaaauggucgaugcacucuaucaggcgaccuccuggggaccacaccaaguagccccgcugaucuuggagccuucgucggccugagagcggagccugguucuagggugguagaauugucccagccaaaccaggaggacuuucacguugggucagcccccgcaccgcucggauucccugauuuuagcgacuguagugugacuuucgucguggcuucugccaccacagucggcgaacggaccgugaacacgcguucccugcagaauuuuacuccagcuuuaggccauauuacauucgacgaggaggcccccgcagaucuguuucgcgcccacuucagaaaccucugggaaccuaccgagcacagcuuuuggaggauccccgacuaccgggcugauguucuugggucggacuucgcgccaucuguguccgcaccuggaguaggugaaacucuguuguuuuucaugugcaaugucccccgacuaaacggcgccaauccaaacccguguccuugccugcucccccaagaguggauaacacauuucgugucagaacgcgcugcccugcagagugauguugcacuucugaauuaugugaacccaaauaccgggagagucuuguuugaggccaaccucuacgcuaauggauuccugacggugaacuuaggcgccagcgaccaggcaacccugcccguagaugguaucuuuaaguucguguccuggguuucuuuuuauuaccaacuaaggccugucgggaaugcgagcgugggccggcgccucuga

SEQ ID NO: 21816 - RNA, 1551 nt, Artificial Sequence
  derived and/or modified sequence opt3 from VP1__Norovirus_and/or_Norovirus-like__EU794907
augaagaugaccgacagagaugugacagacagcgcccccgcucugggccagguccucccuccagagguugaagcauccgugccgguagagcccacugccggggcgccuguggcugccccaacggcaggacaagucaaccccaucgauccuuggauuuucgccaauuuugugcaggcuccacagggugaguucaccauaucucccaacaauaacccuggcgaaauccuuuuugaacuggaguuggggccagacuuaaauccguaccuggcacaccuaaggcggauguauaacggauggacaggcucaaugcgcguucgagugcuccuggccgguaaugcuuucagugccgggaaagucgugguauuuugcguucccccuggauucgauacuagcuaccuuaccccaucccaggcgacacaauuuccccaugugcugauugacguccgugcaccugagccaguggaaaugcccuuggaggaugugagaaacauccucuuccaccagggcccggacucuaggaugcggcugaugggcaugcuguauaccccucuccgcgccaauucgggggcugaucccuuugucguuacuggaagaguguuaacauguccaucaccuaacuucagcuuuuucuuucugguacccccaaccguggaagagagggagcccccuuucacgcuuccaaauuugccggucaacaaucugagucauucccgggugauggaacccauugcccagaugaugucuagccgcaacuucccugcauccguucaguuucaaaauggucgaugcacucuaucaggcgaccuccuggggaccacaccaaguagccccucugaucuuggagcuuucgugggccugaucgccgagccugguuccagagucguggaauugucacagccaaaccaggaggacuuucacgcggggagcgcccccgcaccguucggauuuccugauuucagugacuguucucucacuuuuguaguugcuuccgccaccacagugggcgaaaggaccgucaacgcucggagcccacagaauuucacgcccgcccugggccauauaacuuuugacgaggaggccccugcagauuuauuccgugcucaucugcgcaaccucugggaccccacagaacacucguuuuggagaaucccagauuacagggcggacgugcuugggucugaguucgcaccuuccgucucagcccccggagugggugaaacccuguuguuuuucaugugcaauguuccacggcuaaacggcgcuaauccgaacccuugucccugccugcucccacaagaguggauuacucacuucgugagugaacgagccgcacugcagagcgauguagcccuucugaauuaugucaaccccaauacagggcgcguguuguuugaggcuaagcucuacgccaacggauuccugaccguuaauuuaggcgcauccgaccaggcgacgcugccuguggaugguaucuuuaaauucgucucuugggugagcuuuuauuaccaacuaagaccaguagggaacgcuucagugggcaggcggcucuga

SEQ ID NO: 21817 - RNA, 1551 nt, Artificial Sequence
  derived and/or modified sequence opt3 from VP1__Norovirus_and/or_Norovirus-like__AY126474
augaagaugaccgacagagauacaaucgacagcgcccccgcucugggccaggugcucccuccagaggucgaagcauccguuccgguggagcccacugccggggcgccuguagcugccccaacggcaggacaagugaaccccauugauccuuggauauucgccaauuuuguccaggcuccacagggugaguucaccaucucucccaacaauaacccuggcgaaauucuuuuugaacuggaguuggggccagacuuaaauccguaccuggcacaccuaaggcggauguauaacggauggacaggcucaaugcgcgugcgaguucuccuggccgguaaugcuuucagugccgggaaaguggucguguuuugcguacccccuggauucgauacuagcuaccuuaccccaucccaggcgacacaauuuccccauguucugaucgacgugcgugcaccugagccagucgaaaugcccuuggaggaugugagaaacauucucuuccaccagggcccggacucuaggaugcggcugaugggcaugcuguauaccccucuccgcgccaauucgggggcugaucccuuuguggucacuggaagaguuuuaacauguccaucaccuaacuucagcuuuuucuuucuggugcccccaaccguagaagagagggagcccccuuucacgcuuccaaauuugccggugaacaaucugagucauucccgggucauggaacccaucgcccagaugaugucuagccgcaacuucccugcauccgugcaguuucaaaauggucgaugcacucuaucaggcgaccuccuggggaccacaccaaguagccccgcugaucuuggagccuucguuggccugauagcggagccugguucuagaguggucgaauugucccagccaaaccaggaggacuuucacgccgggucagcacccgcuccguucggauuuccugauuucagcgaauguagucucacuuuugugguagccucugcuaccacaguuggcgagaggaccgugaacacgcggucccugcagaauuucacuccagccuuaggccauaucacauuugacgaggaagcacccgccgaccuguuccgugcucaccuccgcaaccuuugggauccuaccgagcacagcuuuuggaggauucccgacuacagagcggauguccuggggucggaguucgcaccaucuguguccgccccuggagucggugaaacuuugcuauuuuucaugugcaaugugccccggcugaacggcgcuaauccagggcucuguccgugccugcuuccucaagaauggaucacacauuucguuucagagcgagccgcacugcagagugacguggccuugcucaacuauguaaaucccaacaccggacgcguccuguuugaguguaaguuauacgcuaauggcuuccugacggugaaccuaggugccagcgaucaggcaacccucccaguugacgggauuuuuaaauucguguccugggucucuuuuuauuaccaacugagacccgugggcaaugcgagcguaggaaggcggcuuuga

SEQ ID NO: 21818 - RNA, 1551 nt, Artificial Sequence
  derived and/or modified sequence opt3 from VP1__Norovirus_and/or_Norovirus-like__JX145650
augaagaugaccgacagagauaucguggacagcgcccccgcucugggccagguccucccuccagagguugaagcauccgugccgguagagcccacagccggggcgccuguggcugccucuacugcaggaagggucaacccaauugaucccuggauauucgccaauuuugugcaagcuccucagggugaauuuacgaucucaccaaacaauaaccccggcgagauucuuuuugaacuggaguuggggccugacuuaaauccauaccuggcacaccuacggcgcauguauaacggauggaccggcaguaugcgaguucgugugcuccuggccgguaaugcuuucagcgccgggaaagucgugguauuuugcguuccgcccggauucgauacauccuaccuuacuccuucucaggcgacccaguuuccacaugugcugaucgacgucagagcacccgagccuguggauaugccauuggaagacgugaggaacauucucuuccaccaaggccccgauucgcggaugcgccugaugggcaugcuguauacaccgcucagagccaauucaggggcugacccuuuugucguuaccggaaggguguuaacuugucccagcccaaacuucaguuucuucuuucugguaccucccacaguggaggaacgggagccacccuucacccuuccuaauuugccagucaacucccugucucauagccgcgugauggagccgaucgcccagaugauguccucacgaaguuuccccgcaagcguucaguuucagaaugguagaugcacgcuaucuggcgaucuccuggggacuaccccuuccucaccagcugaccuuggagccuucgugggccugauagcggaacccgguagcagggucguggaguugagucaaccuaaccaggaagauuuucacgccgggucugcaccagcucccuucggauuuccggacuucuccgaguguagcguaacauuuguuguggccucggcuacuaccgucggcgaacggacagugaaugcccguaacccucagaacuucaccccagcacucggccauaucacguuugacgaggaggcccccgcugaucuguuccgcgcgagauuuaggaauuuaugggaaccuacugagcacucuuucuggcggauucccgacuaccgagcagauguccugggguccgacuuugccccaucagugagugcuccuggaguuggugaaacacuccuuuucuucaugugcaacgugccccgccugaauggcgccaacccaaauccguguccuugcuugcuaccccaggaguggaucacccacuuuguaagcgaaagagcagcccugcaauccgaugucgcucuccugaacuaugugaauccaaacacugggaggguucuuuucgaggccaagcuguacgcaaauggauuuuugacagugaaccucggcgcgucugaccaggcuauucugcccgucgaugguaucuucaaauuugugagcuggguaucauucuauuaccaguuacggccuguggggaauauaaguguuggccgcagacuguga

SEQ ID NO: 21819 - RNA, 1548 nt, Artificial Sequence
  derived and/or modified sequence opt3 from VP1__Norovirus_and/or_Norovirus-like__AY549161
augaagaugaccgacagagauacaacugacagcgcccccgcucugggccaggugcucccuccagaggucgaagcauccguuccgguggagcccacggccggggcgccuguagcugccgcaaccgccggacaagugaacccaaucgaucccuggauuuucgcuaauuuuguccaggcaccucagggugaguucacaauaucuccaaacaauaaccccggcgaaauccuuuuugaacuggaguuggggccugacuuaaauccauaccuggcccaccuaaggcggauguauaacggauggacuggcucaaugcgcgugcgaguucuccuggcugguaaugccuucagugcggggaaaguggucguguuuugcguaccgcccggauucgaugcaagcuaccuuaccccuucccaggccacacaauuuccacauguucugauugacgugcgugcucccgagccugucgaaaugccauuggaggaugugagaaacauccucuuccaccagggccccgacucuaggaugaagcugaugggcaugcuguauaccccgcuccgggccaauucgggggcagauccuuuuguggucacuggacgcguuuuaacaugucccucaccaaacuucagcuuuuucuuucuggugccucccaccguagaagagagagaggcuccauucacgcuucccaauuugccugugaacagucugucccauucuagguacgucgguccaauuaugcagaugaugagcucccggacuuucccggccucagugcaguuucaaaauggccgcugcacccuaaguggggaccuccugggaacaacucccucuagcuccgcggaucuuggcgccuucguuggucugaucgcagaagcugggucacgaguggucgaguugagccagccuaaccaggaagacuuucacgccggaagugcuccagcaccccucggcuucccugauuuuucugacuguucccugaccuucgugguagccagcuuaacaaccguuggcgagagaacggugaaugccaggucgcugcagaacuuuacuccagcucucgggcaugucacauucgacgaagaggcgcccgcagaucuuuuucgggcccgucugcgcaacuugugggacccgaccgagcacucuguguggagaauaccugauuauagggcugacguccuaggauccgaguucgccccaucagugagugcacccgguguuggcgaaacucugcucuuuuucaugugcaaugugccucaccaaacaggggccaaccccaauccauguccuugccugcuuccccaggaauggaucacccauuuuguaagcgagcgggcugcccugcaguccgaagucgcauugcucaacuacgugaauccaaacacgggacgaguucuguucgaguguaaauuauaugcgaauggcuuccugaccgugaaccuaggugcuucugaucaagucagccucccgguggacgggauuuuuaaguucguaucaugggugaguuuuuacuaccagcugcgcccuguuggcaauacaggagucggcagaagguga

SEQ ID NO: 21820 - RNA, 1548 nt, Artificial Sequence
  derived and/or modified sequence opt3 from VP1__Norovirus_and/or_Norovirus-like__AY549164
augaagaugaccgacagagaugccguggacagcgcucccgcacugggccagguccucccuccagagguugaagccuccgugccgguagagcccacagcgggggcuccuguggccgcaccaacugccggacaagucaaccccaucgauccuuggauuuucgcuaauuuugugcaggcaccacagggugaguucacgauaucucccaacaauaacccuggcgaaauccuuuuugaacuggaguuggggccagacuuaaauccguaccuggcccaccuaaggcggauguauaacggauggaccggcucaaugcgcguucgagugcuccuggcugguaaugccuucagugcggggaaagucgugguauuuugcguucccccuggauucgauacaagcuaccuuacuccaucccaggcaacccaauuuccccaugugcugauugacguccgugccccugagccaguggaaaugcccuuggaggaugugagaaacauccucuuccaccagggcccggacucuaggaugcggcugaugggcaugcuguauacaccucuccgcgcuaauucgggggccgaucccuuugucguuaccggaagaguguuaacuuguccaucaccuaacuucagcuuuuucuuucugggucccccaacaguagaagagagggagccccuuuucaccuugccuaaucugccagugaacaaucuaagucauucccgggucauggaaccgauugcacagaugaugucuagccgcuccuuccccgcuucagugcaguuucaaaacggccgaugcacgcucaguggggaccugcuuggaacuaccccuagcucuccagccgaucugggcgcguucguugguuugagagccgagcccggguccaggguggucgaacucucacagccuaaucaggaggacuuucacgcaggaagcgcuccagcccccuucggcuuuccggauuucagugacuguucugugacauuuguaguugcuaacgccacuaccgugcaggaaugcacagucaacacccggaauccucaaaacuucacgccagcacugggccauaucacuuuugacgaggaggcccccgcugauuuauuccgugcgcgcuuuagaaaucugugggacccuacagaacacuccuucuggaggauacccgauuaccgggcagaggugcucgggagcgacuuugccccaucggucucugcuccuggagugggugaaacccuucuguucuucauguguaacguuccccgauccaauggcgccaacccaaauccgugcccuuguuugcuaccccaggaguggaucacucacuuugugucagaacgcgcagcccugcagagugauguagcucuccugaacuaugucaauccaaacacagggagagugcuuuucgaggccaagcuguacgcaaauggauuuuugaccguuaaccucggcgcgagcgaccaagcuacgcugcccguggaugguauuuucaaauuugucuccugggugucuuucuauuaccaguuaaggccuguagggaauaccagcgugggccggcgcuga

SEQ ID NO: 21821 - RNA, 1548 nt, Artificial Sequence
  derived and/or modified sequence opt3 from VP1__Norovirus_and/or_Norovirus-like__AY126476
augaagaugaccgacagagauacaguggacagcgcccccgcucugggccagguccucccuccagagguugaagcauccgugccgguagagcccacugccggggcgccuguggcugccccaacggcaggacaagucaaccccaucgauccuuggauuuucgccaauuuugugcaggcuccacagggugaguucaccauaucucccaacaauaacccuggcgaaauccuuuuugaacuggaguuggggccagacuuaaauccguaccuggcacaccuaaggcggauguauaacggauggacaggcucaaugcgcguucgagugcuccuggccgguaaugcuuucagugccgggaaagucgugguauuuugcguucccccuggauucgauacuagcuaccuuaccccaucccaggcgacacaauuuccccaugugcugauugacguccgugcaccugagccaguggaaaugcccuuggaggaugugagaaacauccucuuccaccagggcccggacucuaggaugcggcugaugggcaugcuguauaccccucuccgcgccaauucgggggcugaucccuuugucguuacuggaagaguguuaacauguccaucaccuaacuucagcuuuuucuuucugguacccccaaccguggaagagagggagcccccuuucacgcuuccaaauuugccggucaacaaucugagucauucccgggugauggaacccauugcccagaugaugucuagccgcuccuucccugcaucaguucaguuucaaaacggucgaugcacucuaaguggcgaccuccuggggaccacaccaagcucucccgcugaucuuggagccuucgugggccugagagcggagccugguuccagggucguggaauugucacagccaaaucaggaggacuuucacgccgggagcgcacccgcuccguucggauuuccugauuucagugacuguucuguaacuuuuguuguggccuccgcuaccacaguccaggaaugcaccgugaacacgcggaaccuccaaaauuucacuccagcccugggccauaucacauuugacgaggaggcacccgccgauuuauuccgugcucgcuuuagaaaccugugggacccuaccgaacacagccucuggaggauacccgauuaccgggcggagguccuuggcucggacuucgcaccaucuguguccgccccugggguuggagaaacucuguuguuuuucauguguaaugugccccgaucaaacggugcuaauccaaacccgugcccuugucuacugccccaggaguggaucacacacuucguaagugaacgcgccgcacuccagagcgaugucgcccugcuuaauuaugugaacccaaauaccggcagaguucuguuugaggcuaaguuguacgccuccggguuccucacggugaaccugggagcaucugaccaagcgaccuuacccgucgauggcauuuuuaaauucgugagcuggguaucauuuuauuaccagcugaggccuguggguaauacaaguguugggcggcgcuga

SEQ ID NO: 21822 - RNA, 1548 nt, Artificial Sequence
  derived and/or modified sequence opt3 from VP1__Norovirus_and/or_Norovirus-like__EU794905
augaagaugaccgacagagauacaaucgacagcgcccccgcucugggccaggugcucccuccagaggucgaagcauccguuccgguggagcccacugccggggcgccuguagcugccccaacggcaggacaagugaaccccauugauccuuggauauucgccaauuuuguccaggcuccacagggugaguucaccaucucucccaacaauaacccuggcgaaauucuuuuugaacuggaguuggggccagacuuaaauccguaccuggcacaccuaaggcggauguauaacggauggacaggcucaaugcgcgugcgaguucuccuggccgguaaugcuuucagugccgggaaaguggucguguuuugcguacccccuggauucgauacuagcuaccuuaccccaucccaggcgacacaauuuccccauguucugaucgacgugcgugcaccugagccagucgaaaugcccuuggaggaugugagaaacauucucuuccaccagggcccggacucuaggaugcggcugaugggcaugcuguauaccccucuccgcgccaauucgggggcugaucccuuuguggucacuggaagaguuuuaacauguccaucaccuaacuucagcuuuuucuuucuggugcccccaaccguagaagagagggagacgcccuucacucuuccuaauuugccagugaacagucugucccauucucgggccauggaaccgaucgcacagaugaugagcucccgcaauuuccccgcuucaguccaguuucaaaacggucgaugcacccuaaguggcgaccuccuggggacaacuccuagcucuccagccgaugugggaaccuucguuggccuuauagcggagcccgguucccacguggucgaacugucacagccuaaucaggaggacuuucaugccgggagcgcaccagcucccuucggauuuccggauuucagugacuguucuuugacauuugugguagccuccgcuagcaccguuggcgaaagaacggugaacacuaggucgccucagaacuucacaccagcccucggccacaucaccuuugacgaggaggcacccgccgaucuguuccgggcucacuuacguaaucugugggacccuacugaacauucuuuuuggcgcauucccgauuacagagcggacguccucgggggagaguucgcaccauccgugucagccccuggugucggcgaaacacuucuguuuuucaugugcaacgugcccaggaguaauggggcuaacccaaauccguguccuugcuugcuaccccaagaguggaucacccacuucguuagcgaacgggccgcacugcaguccgauguggcccuccugaacuauauuaauccaaacacgggacgaguacuuuuugaguguaagcuguacgcuaauggcuucuugaccgucaaccucggugccucugaccaggcaacacugcccguggaugggaucuuuaaauucguuagcugggugucauuuuauuaccaauuacgcccugucggcaauauaggagugggcagaagguga

SEQ ID NO: 21823 - RNA, 1548 nt, Artificial Sequence
  derived and/or modified sequence opt3 from VP1__Norovirus_and/or_Norovirus-like__EU794906
augaagaugaccgacagagauacaaucgacagcgcccccgcucugggccaggugcucccuccagaggucgaagcauccguuccgguggagcccacugccggggcgccuguagcugccccaacggcaggacaagugaaccccauugauccuuggauauucgccaauuuuguccaggcuccacagggugaguucaccaucucucccaacaauaacccuggcgaaauucuuuuugaacuggaguuggggccagacuuaaauccguaccuggcacaccuaaggcggauguauaacggauggacaggcucaaugcgcgugcgaguucuccuggccgguaaugcuuucagugccgggaaaguggucguguuuugcguacccccuggauucgauacuagcuaccuuaccccaucccaggcgacacaauuuccccauguucugaucgacgugcgugcaccugagccagucgaaaugcccuuggaggaugugagaaacauucucuuccaccagggcccggacucuaggaugcggcugaugggcaugcuguauaccccucuccgcgccaauucgggggcugaucccuuuguggucacuggaagaguuuuaacauguccaucaccuaacuucagcuuuuucuuucuggugcccccaaccguagaagagagggagacgcccuucacucuuccuaauuugccagugaacagucugucccauucucgggucauggaaccgaucgcccagaugaugagcucccgcaauuuccccgcaucagugcaguuucaaaacggucgaugcacccuaaguggcgaccuccuggggacaacuccuagcucuccagcugaucuuggaaccuucguuggccugauagccgagcccgguucccacguggcggaauugucacagccuaaucaggaggacuuucaugccgggagcgcaccagcucccuucggauuuccggauuucagugaauguucucucacauuugucguggccuccgcuagcaccguaggcgagagaacgguuaacacuaggucgcugcagaacuucaccccugccuuaggccacaucacauuugacgaggaagcaccagccgaccuguuccgggcucaccuccguaaucuuugggaucccacugagcauucuuuuuggcgcauuccugacuacagagcggaugugcugggaggggaguucgcacccuccgucucagccccaggugugggcgaaacauugcuauuuuucaugugcaacgucccuaggcugaauggggcuaaccccaauccauguccgugccuccugccucaagaauggaucacccacuucgugagugagcgggccgcacuucagagcgacguugcccuguugaacuauauuaaucccaacacgggacgagugcucuuugaguguaagcuguacguaaauggcuucuuaaccgucaaccugggugcuuccgaucaggccacacuaccaguggacgggaucuuuaaauucguuucuugggugagcuuuuauuaccaacuccgccccgucggcaauauaggagugggcagaagguga

SEQ ID NO: 21824 - RNA, 1548 nt, Artificial Sequence
  derived and/or modified sequence opt3 from VP1__Norovirus_and/or_Norovirus-like__AY126475
augaagaugaccgacagagauacagccgaccccgcuccugcacugggccaggugcucccaccggaggucgaagccagcguucccguggagccuacugcgggggcuccaguagccgcacccacggccggacaagugaacccuaucgauccauggauuuucgcuaauuuuguccaggcaccccagggugaguucaccauauccccuaacaauaacccaggcgaaauccuuuuugaacuggaguuggggccggacuuaaaucccuaccuggcccaccuaaggcggauguauaacggauggacaggcucuaugcgcgugcgaguucuccuggcugguaaugccuucucagcggggaaaguggucguguuuugcguaccuccaggauucgauaccaguuaccuuacccccagccaggcaacacaauuuccucauguucugauugacgugcgugucccagagcccguggaaaugccguuggaggaugugagaaacauccucuuccaccagggcccugacuccaggaugcggcugaugggcaugcuguauacuccccuccgcgccaauucuggggcugauccauuugucguuacuggaagaguguuaacauguccuucgcccaacuucucauuuuucuuucugguaccacccaccguggaagagagggagccuccauucacgcuuccgaauuugcccgucaacaaucugagccauagucgggugauggaaccuauugcccagaugauguccucucgcagcuucccagcauccguucaguuucaaaacggucgaugcacucuaucaggcgaccuccuggggaccacacccaguagcccugcugaucuuggagccuucgugggccugaucgcggagccagguucuagagucguggaauuguuucagcccaaucaggaggacuuccacgccggguccgcaccggcuccuuuuggauucccagauuuuucagaauguagcguaacuuucguugugaguucugccaccacagucggcgagaggaccgugaacgcucggaaccagcaaaauuuuacgcccgcccucggccauauaacuuucgacgaggaagccccugcagaccuguuucgugcuugcuuccgcaacuuaugggagcccacagaacacuccuuuuggagaaucccagauuacagggcggacguccuggggagcgauuucgcaccuucggugucugcccccggaguuggugagacccuccuuuucuuuauguguaaugugccacggcugaacggcguaaauccggggccuugccccuguuugcuaccacaggaauggauuacucacuucgucuccgagcgagcugcccugcagucagacguggcacuccugaacuauguuaaucccaacacaggacgcgugcuuuuugaggccaagcuguacgcuaauggcuucuugaccgucaaccucggugccagugaucaagcaacgcugccuguggacgggaucuuuaaauucguaagcuggguguccuuuuauuaccaguuaagaccaguuggcaauaccucugucggaaggcgguga

SEQ ID NO: 21825 - RNA, 1548 nt, Artificial Sequence
  derived and/or modified sequence opt3 from VP1__Norovirus_and/or_Norovirus-like__AF542084
augaagaugaccgacagagauacaguggacagcgcccccgcucugggccagguccucccuccagagguugaagcauccgugccgguagagcccacugccggggcgccuguggcugccccaacggcaggacaagucaaccccaucgauccuuggauuuucgccaauuuugugcaggcuccacagggugaguucaccauaucucccaacaauaacccuggcgaaauccuuuuugaacuggaguuggggccagacuuaaauccguaccuggcacaccuaaggcggauguauaacggauggacaggcucaaugcgcguucgagugcuccuggccgguaaugcuuucagugccgggaaagucgugguauuuugcguucccccuggauucgauacuagcuaccuuaccccaucccaggcgacacaauuuccccaugugcugauugacguccgugcaccugagccaguggaaaugcccuuggaggaugugagaaacauccucuuccaccagggcccggacucuaggaugcggcugaugggcaugcuguauaccccucuccgcgccaauucgggggcugaucccuuugucguuacuggaagaguguuaacauguccaucaccuaacuucagcuuuuucuuucugguacccccaaccguggaagagagggagccccuuuucacguugccuaaucugccagucaacaaucuaagucauucccgggugauggaaccgauugcccagaugaugucuagccgcaacuuccccgcauccguucaguuucaaaauggucgaugcacucucucaggcgaccugcuugggaccacaccuaguagcccagcugaucugggagccuucgugggcuugagagcggagcccgguucuagggucguggaacucucccagccuaaccaggaggacuuucacgccgggucagcaccagcuccccugggauucccggauuuuagcgacuguaguguaacuuucguuguggccaacgcuaccacaguccaggaaugcaccgugaauacgcggaacccucaaaauuuuacuccagccuuaggccauaucacauucgacgaggaggcacccgccgaucuguuucgugcucacuuccgcaaccucugggacccuaccgaacacucuuuuuggagaauacccgauuacagggcggagguccuuggcuccgacuucgcaccaagcgugucggccccugggguuggagaaacucuguuguuuuucauguguaaugugccccggucuaacggugcuaauccaaacccgugcccuugucuacugccccaggaguggaucacacauuucguauccgaacgagccgcacuccagucagaugucgcccugcuuaauuaugugaacccaaauaccggccgcguucuguuugaggcuaaguuguacgccaacggguuccucacggugaaucugggagcaagugaccaagcgaccuuacccgucgauggcauuuuuaaauucgugagcuggguauccuuuuauuaccagcugagaccuguggguaacacaucuguugggaggcgguga

SEQ ID NO: 21826 - RNA, 1536 nt, Artificial Sequence
  derived and/or modified sequence opt3 from VP1__Norovirus_and/or_Norovirus-like__KC695807
auggcccuggagcccguggucggcgcugcaaucgccgcgccuguugcugggcagcaaaacgugauugacccauggauaagaaauaacuucguacaggccccgggaggugaauuuaccgugagccccaggaaugcaccuggcgagauccucugguccgccccacuugggcccgaucugaacccuuacuugucucacuuagcucggauguauaauggauacgcaggcgguuucgaaguccaggugauucuggccgggaacgcuuuuacagccggaaagguuaucuucgcggcagugccacccaauuuuccuacugagggccuaucaccaagucaggucacgauguucccgcauauugugguagacguucgccaacucgaacccgugcugaucccucuuccagauguccgaaacaauuuuuaucacuacaaccagagcaaugaccccaccauaaaacugaucgccauguuguauacaccucuccgugcuaacaaugccggcgaugacguguucacuguguccugcagaguccugaccaggccaucucccgauuuugacuucauuuuucugguuccgccuacaguggagucgcggaccaagcccuucucaguaccagugcucacugucgaggaaaugacaaacagccgcuuuccuauccccuuagagaaacuguucaccgggccaaguuccgcauucgugguucagccccagaauggaagauguacgacugauggugugcuuuugggcaccacacaacugucuccugucaacauuugcacuuuuaggggagacgugacccauaucacagggagccggaacuacaccaugaaucuagcuucccagaacuggaauaacuaugauccaacggaagagauaccggcgccccucggcgccccugacuucguagguaagauucaggggaugcugacucagacaacccgcgccgauggaucaacucgaggccacaaagcaacaguuuacaccggcagugcugacuuugccccaaaacuugggagagugcaauucgagacggacaccgaucaugacuuugaagcuaaucagaacacaaaguucacucccgucggagugauccaggaugguagcaccacacacaggaaugagccucaacaguggguccugccaucuuacuccggccggaacacucacaaugugcauuuggcccccgcaguugccccgaccuuuccuggggaacagcuccuguucuuucguucaacaaugccaggauguagcggcuaucccaacauggacuuagauugccugcucccucaggagugggugcaauacuucuaucaggaagcugcgcccgcacagagugacguagcccuucugcgcuuugucaauccagauaccgguagaguguuguucgaguguaagcuacacaagucuggguacguuacuguggcucauacgggccagcacgaccuggucauuccucccaacggauauuuuagguucgauuccugggugaaucaauucuacacacucgccccaaugggcaacgggaccggacggcgauga

SEQ ID NO: 21827 - RNA, 807 nt, Artificial Sequence
  derived and/or modified sequence opt3 from VP2_capsid_protein__Norovirus__AGL98415
auggccggcgcuuucuuugcagggcuggccagcgacgugcucggauccggucuuggcucucugaucaacgcgggggcuggagccauuaaucagaaggucgaguucgaaaacaauagaaaauugcaacaggcaucauuucaguucaguagcaacuuacagcaagccuccuuucagcacgauaaggagaugcugcaggcucagauagacgcaacccauaaacuacaacagggccucaugcagaucaagcaggccguucugcuugaagguggguucucugcugccgaugcggcaaggggagccauuaaugcucccaugacaaaagcccuggacuggucgggcacucgguacugggcaccugaggcucgcgugacgaccuauaacgccggccacuuuucaccaagccaaccgagucgagcgcccuccgggcguaucaauucuggaacaccuacuccagccagaaacagccucaauucccccgcaaccucaaguguagcuacaagcgugcauucuaaccagaccgccuccacuaggauugguucaagcgcuggcagugggacaucugucuccagcuugccuucgaccucucggacgcgcaauuggguggaagaucagaacagauccguuucaccauucaugaggggagcccugaauaccaguuuugugacucccccuagcucccggucuagcaaccaaucaacagucaguacugugccaaaggagauccuggacuccuggaccggcgcauucaauacacgccgacagccgcucuuugcccacauaagaaggcggggugagagccguguauga

SEQ ID NO: 21828 - RNA, 792 nt, Artificial Sequence
  derived and/or modified sequence opt3 from VP2_capsid_protein__Norovirus__AGL98417
auggccggcgcuuucuuugcagggcuggccagcgacgugcucggaaccggucuuggcucccugaucggggcgggagcuggcgccauuaaccagaaggucgaguacgaaaauaacagaaaauugcaacaggcaucuuuccaguuuucaagugauuuacagcaagccagcuuccagcacgacaaggauaugcugcaggcucagauaaaagcaacacaaaagcuacagcaugaccucaugaggguuaaacaggccgugcugcuugaggguggguuuucccccacugaugcugcccggggagcgaucaaugcaccuaugacgaagguacuggacuggucuggcacccgcuauugggccccaggcgcucgagugacaacuucgaacgccgggcaguucucauuuagccaaccgauucgugaacccaguggaagaaccgcuccugcaagguccccagccaaucgggcgucuagcgucuccgcccccucaaguacauugagcaaccagaccacuucuacacgccucgguaccuccgcaggcucaggggcuagcgugaguggaucuuccagcgccucgagaguuaggucuuggguggagggccagaaucggucccugucaccuuucauggauggugcucugcacacgaguuuugucacuccacccagcuccaagucuagcucacaagggaccgugaguacaguaccuaaagaaguucucgacuccuggacuggagccuucaacacccaucgccagccauuauuugcacacgugcgaagacagggcgagagcagggucuga

SEQ ID NO: 21829 - RNA, 648 nt, Artificial Sequence
  derived and/or modified sequence opt3 from capsid_protein_VP2__Norovirus__AFI08232
auggcccaggcugugcugggcgcaaucgccgcgaccgcugccgggagcgcagucggagccgguauucaagcuggcacagaggcagcccuccagcaccagagauuccagcaagaccuuacucugcaguccaacacguuuaagcaugauaaagaaauguuggcuaugcagguugaggccucuaccucauuacugcagaauagucuaaacacaagguacaaucuccugacucaagcggggcuuaccagcgcagacgccgcucgggccguggcaggagcucccguaacacgcguggucgauuggaacggcacccgaauagccgcgccucuguccacugccacaaccuugcguucugguggguucaugucgaucccagugauguauagaggagcaaagacggaacagcagaaacucacuggcuuuucaaauccgaacuacgagaccggcagcaguguuuccaggacaucucagugggugagcucccaaaauucaaugcggaguagcgucgcucccuuccacccugacgcccugcgcacuaccugggugacaccacccgggucuuccucaaccagcacgguaaguucugcuuccagcauuccuagauuuuucaacacugaaaggcugccacucuuugccaauaacaagcgguga

SEQ ID NO: 21830 - RNA, 807 nt, Artificial Sequence
  derived and/or modified sequence opt3 from capsid_protein_VP2__Norovirus__AFI08235
auggccggcgcuuucuuugcagggcuggccagcgacgugcucggauccggucuuggcucucugaucaacgcgggggcuggagccauuaaucagaagauagauuucgagaacaauagaaaauugcaacaggcaucauuucaguucaguagcaacuuacagcaagccuccuuucagcacgacaaggaaaugcugcaggcucagaucgaggcaaccaaaaagcuacaacaggaaaugaugaaagucaagcaggccaugcuccuggagggcgguuucucugaaacagaugcugccaggggagcgauuaaugcacccaugacuaaggcccuugacuggucggggacgcgguacugggcuccugaugcccgcaccacaacuuauaacgcaggccgauuuucaaccccacagccgagcggcgcucugcccgggcguaucaauccuagaacaccaacccccgccaggggaaguuccucuacuagcuccaacgcgucaacagccaccaguauucauagcaaucaaacgguuucuacucgguuggguuccaccgcaggcucagggacaaacgugagcagucucccuucuacugcucgcaccagauccuggguagaggaccagaauaggaaccugagcccauucaugcggggagcccacaauaucucguuugugacacccccuucuucccgcucaaguagccagggcaccgucuccacggugccaaaagagguucugaacucuuggacuggugcuuucaauacacgaagacaaccgcucuuugcccauauaaggcggcagggggaaagccguguguga

SEQ ID NO: 21831 - RNA, 807 nt, Artificial Sequence
  derived and/or modified sequence opt3 from capsid_protein_VP2__Norovirus__AFI08238
auggccggcgcuuucuuugcagggcuggccagcgacgugcucggauccggucuuggcucucugaucaacgcgggggcuggagccauuaaucagaagauagauuucgagaacaauagaaaauugcaacaggcaucauuucaguucaguagcaacuuacagcaagccuccuuucagcacgacaaggaaaugcugcaggcucagaucgaggcaaccaaaaagcuacaacaggaaaugaugaaagucaagcaggccaugcuccuggagggcgguuucucugaaacagaugcugccaggggagcgauuaaugcacccaugacuaagguucuugacuggucggggacgcgguacugggccccugaugcucgcaccacaacuuauaacgccggccgauuuucaaccccacagccgagcggcacacugcccgggcguaucaauccuagaaccccaacucccgcaaggggaaguuccucuacaagcuccaacgcuucaaccgccacgaguauucauagcaaucaaacugugucuacccgguuggguuccacagcgggcucaggggccaacguaagcagucucccuucuacugcacgcaccagauccuggguggaggaccagaauaggaaccugagcccauucaugcggggagcucacaauaucucguuugucacacccccuucuucccgcucaaguagccagggcaccguguccacgguuccaaaagaggugcuggauucuugggccggugcuuucaacacucgaagacaaccgcucuuugcccauauaaggcggcguggggaaagccgcgucuga

SEQ ID NO: 21832 - RNA, 807 nt, Artificial Sequence
  derived and/or modified sequence opt3 from capsid_protein_VP2__Norovirus__AFI08241
auggccggcgcuuucuuugcagggcuggccagcgacgugcucggauccggucuuggcucucugaucaacgcgggggcuggagccauuaaucagaagauagauuucgagaacaauagaaaauugcaacaggcaucauuucaguucaguagcaacuuacagcaagccuccuuucagcacgacaaggaaaugcugcaggcucagaucgaggcaaccaaaaagcuacaacaggaaaugaugaaagucaagcaggccaugcuccuggagggcgguuucucugaaacagaugcugccaggggagcgauuaaugcacccaugacuaagguucuugacuggucggggacgcgguacugggccccugaugcucgcaccacaacuuauaacgccggccgauuuucaaccccacagccgagcggcacacugcccgggcguaccaauccuagaacuccaacacccgcaaggggaaguuccucugcuagcuccaacgccucaaccgcgacgaguaucuugagcaaucaaacugccucuacccggcucgguuccacagcaggcucagggacuaacgugagcagucugccuucuaccgcucgcacaagauccuggguagaggaccagaauaggaaccugagcccauucaugcggggagcccauaauauuucguuugugacgcccccuucuucccgcucaaguagccagggcaccgucuccacugugccaaaagagguucucgauucuuggacaggugcuuucaacacccgaagacaaccguuauuugcccacaucaggcggcguggggaaagccgcguguga

SEQ ID NO: 21833 - RNA, 807 nt, Artificial Sequence
  derived and/or modified sequence opt3 from capsid_protein_VP2__Norovirus__AFI08244
auggccggcgcuuucuuugcagggcuggccagcgacgugcucggauccggucuuggcucucugaucaacgcgggggcuggagccauuaaucagaagauagauuucgagaacaauagaaaauugcaacaggcaucauuucaguucaguagcaacuuacagcaagccuccuuucagcacgacaaggaaaugcugcaggcucagaucgaggcaaccaaaaagcuacaacaggaaaugaugaaagucaagcaggccaugcuccuggagggcgguuucucugaaacagaugcugccaggggagcgauuaaugcacccaugacuaagguucuugacuggucggggacgcgguacugggccccugaugcucgcaccacaacucauaacgccggccgauuuucaaccccacagccgagcggcacacugcccgggcguaucaauccuagaaccccaacucccgcaaggggaaguuccaacacaucuagcaaugcuuccaccgccacgucaauucacaguaaccaaacugugagcacccgguuggguucuacagcgggcuccgggacuaauguaucaagccucccuaguaccgcccgcacaagaucuuggguggaggaccagaacaggaaucuguccccauucaugcggggagcacauaacaucagcuuugucacgcccccuucgucucgcuccucaagucagggcaccgugagcacuguuccaaaagaggugcuggauuccuggacaggugcuuucaauacccgaagacaaccgcucuuugcccacauaaggcggcguggggaaucucgcgucuga

SEQ ID NO: 21834 - RNA, 807 nt, Artificial Sequence
  derived and/or modified sequence opt3 from capsid_protein_VP2__Norovirus__AFJ38520
auggccggccccuucuuugcugggcuggcaagcgacgugcucggauccggucuuggcucucugaucaacgccggggcgggagcuauuaaucagaaggucgaguucgaaaacaauagaaaauugcaacaggccucauuucaguucaguagcaacuuacagcaagcauccuuucagcacgauaaggagaugcugcaggcccagauagaagcuacccaaaaacuacagcagggccucaugaagguuaaacaggcagugcugcuugaggguggguucucuacaacugacgccgcuaggggagccaucaaugcgccuaugacgaaggcacuggauuggucgggcacccgguacugggccccagacgcucgcgccacaacuuauaacgcaggccgauuuucaaccccgcaacccuugggggcucucccuggacguauuaauccaagaguacccgccccugcgaggagcaguccauccucucugagcaacgcccccacagcaaccuccguguacucaaaucagacugucaguacacggcuggguagcucugcuggcuccggggccggagugucaagccucccuaguaccgcucgcacgagaucuuggguugaagaucagaacaggaauuuauccccauucaugcggggcgcccugaacacuagcuuugugaccccgcccucgucucgcuccucaaaucaagguacagucaguacugugccuaaggagauccuugacagcuggaccggggcauucaacacacgaagacagccauuguuugcccauauuaggaaacggggagagucccguguauga

SEQ ID NO: 21835 - RNA, 765 nt, Artificial Sequence
  derived and/or modified sequence opt3 from capsid_protein_VP2__Norovirus__AFX71657
auggccggcgcuuucaucgcagggcuggccggagacaugcucaccagcacaguggguucccuugucaacgcgggcgcuucugccauuaaucagaagguugauuuugagaacaauaaauaccugcaaaacgcaucauucaaucacgacaaggaaauguugaacgcccagauagaggcuacuaaaagauuacaggcagauaugaucgccauuaagcagggggugcugacggcuggaggcuuuagucccaccgacgccgcgaggggugcaaucaaugccccuauuacacggguacuagauuggagcgggacucgcuauugggcuccaaacgccaccuccacaaccucuaugucgggaggcuucacuucacaaacagugcaccgaaccacgccgaauuuuaaaacuaaccaggcacccaagagcaccccuaguuccggcucuagcguccguuccaauucaacacagcucaccagucugagcucucacuccucagggagcaguagaucuuccggaagcacugugguuucgucucuuccauccucaaacaggacacgggacugggugaaucagcaaaacuucaaucuggaaccccauaugccugguaguuugcgcaccgcuuuugucacgccacccagcuccacugccucuaacagcgauacagugucaaccguaccuaagaguguucucgacuccuggacuagcgcguucaacacaagaaggcagccacuguuugcccaucugcggcgccgaggcgagucuaauguguga

SEQ ID NO: 21836 - RNA, 780 nt, Artificial Sequence
  derived and/or modified sequence opt3 from capsid_protein_VP2__Norovirus__AFX71660
auggccggcgcuuucguggcagggcuggccggagacguccucagcaacggucuuuccucucugaucaaugcgggcgcuaacgccauuaaucagagagcagaguuugauuucaaccaaagguugcagcaaaauucauuuaaccacgacaaggaaauguuacaggcccagauacaggcuaccaaacagcugcaggcagauaugauggccaucaagcaagggguucuaacagcuggaggcuucagucccacugacgccgcgcggggugcagugaaugccccuaugacgcaggcucucgauuggaacgggacccgcuacugggccccaggaagcaugcgaacaacuuccuauucuggccguuuuaccucgacagcaccggcuagacaggccgacuuccagcacacccaaaauaggcccucaagcggcaguuccguaucuagcuacacuacacaguccucacggccuacccugacgacuaccacagggaguagccacggaacuaccucuuccaacucaacacgcagcaccaaucuuagucagucuacgguguccagagcgacuagcaggacaucggaguggguccgggaucaaaaccgcaaucuggaaccauauaugcauggugccuugcagaccgcauuugugacucccccuucuucccgagcuucagacggcacaguuaguaccgugccaaaagggguccucgauagcuggacgcccgccuucaacaccagaaggcagccucuguuugcucaucugcggaagcguggagagucccgcguguga

SEQ ID NO: 21837 - RNA, 780 nt, Artificial Sequence
  derived and/or modified sequence opt3 from capsid_protein_VP2__Norovirus__AFX71666
auggccggcgcuuucuuugcagggcuggccggagacguggucagcaacgguaucggcucccucauuaaugcgggggcuaacgccguuaaucagaagguggaguacgauuucaacaaacaacuucagauggcaucuuuuaagcacgacaaagaaaugcugcagucacagguauuggccaccaagcaauuacagcaggagaugaugaauauaagacagggagugcugacagcuggcgguuucagucccgcagaugccgcucgcggggccgucaacgcgccuaugacuaaaauccuagacuggaauggaacgcgguauugggcaccaaacagcaugaagaccacauccuacucuggccaauuuucgucaagcccggugcauaggcccccugccgcuccacagcacacugcacccccuaagaguaaacuccagggcgauuccguuucuguguauagcuccccaucaaccgucaguagccagucuacacauuccaccgugcugucagccgggacuggaagcagucgaucuacauccaccagcacggcugccucgacucuuucucguaccuccgacuggguaagaggucaaaaugaaaggcugucacccuucauggauggcgcguugcagacaacuuuuguuaccccuccaaguagcaaggccuccucuaacgggacagugagcaccgucccgaaagcagugcucgacucauggacgcccacuuucaauacacaccggcagccucuguuugcucaucugcgcagaaggggagagagucaaauuuga

SEQ ID NO: 21838 - RNA, 807 nt, Artificial Sequence
  derived and/or modified sequence opt3 from capsid_protein_VP2__Norovirus__AFX71669
auggccggcgcuuucuuugcagggcuggccagcgacgugcucggauccggucuuggcucucugaucaacgcgggggcuggagucauuaaucagaagguugauuucgagaacaauagaaaauugcaacaggccucauuucaguucaguagcaaccagcaacaggcauccuuucagcacgacaaggaaauguuacaggcccaaauagaggcuaccaaaaagcugcagcaggaaaugaugagggugaaacaggcaaugcuacucgagggcgguuucucugaaacagaugccgcucgcggggccaucaaugcgcccaugacuaaggcacuggacuggucgggaacgcgguacugggccccugaugcucgaaccacaacuuauaacgccggccguuuuucaaccccacaaccgagcggcgcaagucccgggagagcuaaucuuagggccacaguaccugcgcggggauccucuagcaccuccucaaacaguagcauugccacuucuguguacuccaaucagacaaccucaacgcgccuggguagcacugcaggcagugggaccucugucuccagcuugccaucgacagcuagaacuaugucuuggguggaggaccagaacaggaaucucucccccuucaugcggggagcccauaacaucucauuuguuaccccuccaaguagccgcuccucuagccaaggcacagugucaaccguccccaaggaggugcuggauaguuggacgggugcuuucaauacucgaagacagccucuguuugcccacauuaggaaacguggggaaucccggguauga

SEQ ID NO: 21839 - RNA, 807 nt, Artificial Sequence
  derived and/or modified sequence opt3 from capsid_protein_VP2__Norovirus__AFX81122
auggccggcgcuuucuuugcagggcuggccagcgacgugcucggauccggucuuggcucucugaucaacgcgggggcuggagccauuaaucagaagauagauuucgagaacaauagaaaauugcaacaggcaucauuucaguucaguagcaacuuacagcaagccuccuuucagcacgacaaggaaaugcugcaggcucagaucgaggcaaccaaaaagcuacaacaggaaaugaugaaagucaagcaggccaugcuccuggagggcgguuucucugaaacagaugcugccaggggagcgauuaaugcacccaugacuaagguucuugacuggucggggacgcgguacugggccccugaugcucgcaccacaacuuauaacgccggccgauuuucaaccccacagccgagcggcacacugcccgggcguaccaauccuagaacuccaacacccgcaaggggaaguuccucuaccagcuccaacgcuucaacggccaccaguaucuugagcaaucaaacugcgucuacacggcucgguuccacugccggcucagggaccaacgugagcagucugccuucuacagcacgcaccagauccuggguagaggaccagaauaggaaccugagcccauucaugcggggagcucauaauauuucguuugugacgcccccuucuucccgcucaaguagccagggcacugucuccacagugccaaaagagguucucgauucuuggaccggugccuucaacacucgaagacaaccguuauuugcucacaucaggcggcguggggaaagccgcguguga

SEQ ID NO: 21840 - RNA, 807 nt, Artificial Sequence
  derived and/or modified sequence opt3 from capsid_protein_VP2__Norovirus__AFX81125
auggccggcgcuuucuuugcagggcuggccagcgacgugcucggauccggucuuggcucucugaucaacgcgggggcuggagccauuaaucagaagauagauuucgagaacaauagaaaauugcaacaggcaucauuucaguucaguagcaacuuacagcaagccuccuuucagcacgacaaggaaaugcugcaggcucagaucgaggcaaccaaaaagcuacaacaggaaauuaugaaagccaagcaggcuaugcuccuggagggcgguuucucugaaacagaugccgcgaggggagcaaucaaugcccccaugacuaagguccuugacuggucggggacgcgguacugggcuccugaugcccgcaccgcaacauauaacgcuggccgauuuucaacuccacagccgagcggcacccugcccgggcguauuaauccuagaacaccaacccccgccaggggaaguuccucuacuagcuccaacgcgucaacagccaccaguauccauagcaaucaaacgguuucuacucgguuggguuccaccgcaggcucagggacaaacgugagcagucucccuucuacugcucgcaccagauccuggguagaggaccagaauaggaaccugagcccauucaugcggggagcccacaauauaucguuugugacacccccuucuucccgcucaaguagccagggcaccgucuccacggugccaaaagagguucuggauucuuggacuggugcuuucaacacacgaagacaaccgcucuuugcccauaucaggcggcguggggaaagccgcguguga

SEQ ID NO: 21841 - RNA, 807 nt, Artificial Sequence
  derived and/or modified sequence opt3 from capsid_protein_VP2__Norovirus__AFX81131
auggccggcgcuuucuuugcagggcuggccagcgacgugcucggauccggucuuggcucucugaucaacgcgggggcuggagccauuaaucagaagauagauuucgagaacaauagaaaauugcaacaggcaucauuucaguucaguagcaacuuacagcaagccuccuuucagcacgacaaggaaaugcugcaggcucagaucgaggcaaccaaaaagcuacaacaggaagucaugaaaguuaagcaggccaugcuccuggagggcgguuucucugaaacagaugcugccaggggagcgauuaaugcacccaugacuaaggugcuugacuggucggggacgcgguacugggccccugaugcucgcaccacaacuuauaacgccggccgauuuucaaccccacagccgagcggcacacugcccgggcguaucaauccuagaaccccaacucccgcaaggggaaguuccucuacaagcuccaacgcuucaaccgccacgaguauucauagcaaucaaacuguaucuacccgguuggguuccacagcgggcucagggacuaacgugagcagucucccuucuaccgcccgcacaagauccugggucgaggaccagaauaggaaccugagcccauucaugcggggagcacacaauaucucguuugugacgcccccuucuucccgcucaaguagccagggcaccguuuccacugugccaaaagagguccuggauucuuggacaggugcuuucaacacccgaagacaaccgcucuuugcccauauaaggcggcguggggaaagccgcguguga

SEQ ID NO: 21842 - RNA, 807 nt, Artificial Sequence
  derived and/or modified sequence opt3 from capsid_protein_VP2__Norovirus__AFX81134
auggccggcgcuuucuuugcagggcuggccagcgacgugcucggauccggucuuggcucucugaucaacgcgggggcuggagccauuaaucagaagauagauuucgagaacaauagaaaauugcaacaggcaucauuucaguucaguagcaacuuacagcaagccuccuuucagcacgacaaggaaaugcugcaggcucagaucgaggcaaccaaaaagcuacaacaggaaaugaugaaagucaagcaggccaugcuccuggagggcgguuucucugaaacagaugcugccaggggagcgauuaaugcacccaugacuaagguucuugacuggucggggacgcgguacugggccccugaugcucgcaccacaacuuauaacgccggccgauuuucaaccccacagccgagcggcacacugcccgggcguaucaauccuagaaccccaacucccgcaaggggaaguuccucuacaagcuccaacgcuucaaccgccacgaguauucauagcaaucaaacugugucuacccgguuggguuccacagcgggcucagggacuaacguaagcagucucccuucuaccgcccgcacaagauccuggguggaggaccagaauaggaaccugagcccauucaugcggggagcacacaauaucucguuugucacgcccccuucuucccgcucaaguagccagggcaccguguccacuguuccaaaagaggugcuggauucuuggacaggugcuuucaacacccgaagacaaccgcucuuugcccauauaaggcggcguggggaaagccgcgucuga

SEQ ID NO: 21843 - RNA, 807 nt, Artificial Sequence; identical to SEQ ID NO: 21842
  derived and/or modified sequence opt3 from capsid_protein_VP2__Norovirus__AFX81137

SEQ ID NO: 21844 - RNA, 807 nt, Artificial Sequence
  derived and/or modified sequence opt3 from capsid_protein_VP2__Norovirus__AFX81140
auggccggcgcuuucuuugcagggcuggccagcgacgugcucggauccggucuuggcucucugaucaacgcgggggcuggagccauuaaucagaagauagauuucgagaacaauagaaaauugcaacaggcaucauuucaguucaguagcaacuuacagcaagccuccuuucagcacgacaaggaaaugcugcaggcucagaucgaggcaaccaaaaagcuacaacaggaaaugaugaaagucaagcaggccaugcuccuggagggcgguuucucugaaacagaugcugccaggggagcgauuaaugcacccaugacuaagguucuugacuggucggggacgcgguacugggccccugaugcucgcaccacaacuuauaacgccggccgauuuucaaccccacagccgagcggcacacugcccgggcguaucaauccuagaaccccaacucccgcaaggggaaguuccucuacaagcuccucagcuaguaccgccacgagcauucauucuaaccaaacuguguccacccgguuggguucaacagcgggcagcgggacuaauguaaguucucucccuuccaccgcccgcacaagaagcuggguggaggaccagaacaggaaucugucgccauucaugcggggagcacacaacaucucuuuugucacgcccccuuccucacgcaguagcucccagggcaccgugucuacuguuccaaaagaggugcuggauagcuggacaggugcuuucaauacccgaagacaaccgcucuuugcccauauaaggcggcguggggaaucacgcgucuga

SEQ ID NO: 21845 - RNA, 807 nt, Artificial Sequence
  derived and/or modified sequence opt3 from capsid_protein_VP2__Norovirus__AFX81143
auggccggcgcuuucuuugcagggcuggccagcgacgugcucggauccggucuuggcucucugaucaacgcgggggcuggagccauuaaucagaagauagauuucgagaacaauagaaaauugcaacaggcaucauuucaguucaguagcaacuuacagcaagccuccuuucagcacgacaaggaaaugcugcaggcucagaucgaggcaaccaaaaagcuacaacaggaaaugaugaaagucaagcaggccaugcuccuggagggcgguuucucugaaacagaugcugccagaggggcgauuaaugcacccaugacuaagguucuugacuggucgggaacgcgguacugggccccugaugcucgcaccacaacuuauaacgccggccgauuuucaaccccacagccgagcggcacacugcccgggcguaucaauccuaggauuccaacccccgcaaggggaaguuccucuacuagcuccaacgcuucaacagccaccaguaucuacagcaaucaaacggugucuacucgguuggguuccaccgcgggcucagggacaaacguaagcagucucccuucuacugcccgcaccagauccuggguggaggaccagaauaggaaccugagcccauucaugcggggagcacauaauauaucguuugucacacccccuucuucccgcucaaguagccagggcaccguguccacgguuccaaaagaggugcuggauucuuggacuggugcuuucaacacacgaagacaaccgcucuuugcccacaucaggcggcguggggaaagccgcgucuga

SEQ ID NO: 21846 - RNA, 807 nt, Artificial Sequence; identical to SEQ ID NO: 21842
  derived and/or modified sequence opt3 from capsid_protein_VP2__Norovirus__AFX81149

SEQ ID NO: 21847 - RNA, 807 nt, Artificial Sequence
  derived and/or modified sequence opt3 from capsid_protein_VP2__Norovirus__AFX81152
auggccggcgcuuucuuugcagggcuggccagcgacgugcucggauccggucuuggcucucugaucaacgcgggggcuggagccauuaaucagaagauagauuucgagaacaauagaaaauugcaacaggcaucauuucaguucaguagcaacuuacagcaagccuccuuucagcacgacaaggaaaugcugcaggcucagaucgaggcaaccaaaaagcuacaacagggcaugaugaaagucaagcaggccaugcuccuggaagguggguucucugagacagaugcugccaggggagcgauuaaugcacccaugacuaagguucuugacuggucgggcacgcgguacugggccccugaugcucgcaccacaacuuauaacgccggccgauuuucaaccccacagccgagcgggacacugcccggacguaucaauccuagaaccccaacucccgcaagggguaguuccucuacaagcuccaacgcuucaaccgccacgaguauucauagcaaucaaacugugucuacccgguugggcuccacagcggggucaggaacuaacguaagcagucucccuucuaccgcccgcacaagauccuggguggaagaccagaauaggaaccugagcccauucaugcggggcgcacacaauaucucguuugucacgcccccuucuucccgcucaaguagccaggguaccguguccacuguuccaaaagaggugcuggauucuuggacaggggcuuucaacacccgaagacaaccgcucuuugcccauauaaggcggcguggagagagccgcgucuga

SEQ ID NO: 21848 - RNA, 807 nt, Artificial Sequence
  derived and/or modified sequence opt3 from capsid_protein_VP2__Norovirus__AFX81155
auggccggcgcuuucuuugcagggcuggccagcgacgugcucggauccggucuuggcucucugaucaacgcgggggcuggagccauuaaucagaagauagauuucgagaacaauagaaaauugcaacaggcaucauuucaguucaguagcaacuuacagcaagccuccuuucagcacgacaaggaaaugcugcaggcucagaucgaggcaaccaaaaagcuacaacaggaaaugaugaaagucaagcaggccaugcuccuggagggcgguuucucugaaacagaugcugccaggggagcgauuaaugcacccaugacuaagguucuugacuggucggggacgcgguacugggccccugaugcucgcaccacaacuuauaacgccggccgauuuucaaccccacagccgagcggcacacugcccgggcguaucaauccuagaaccccaacucccgcaaggggaaguuccucuacaagcuccaacgcuucaaccgccacgaguauucauagcaaucaaacugugucuacccgguuggguuccacagcgggcucagggacuaacguaccuagccucccaaguaccgcccgcacaagaucuuggguggaggaccagaauaggaaccugucccccuucaugcggggagcacagaauaucagcuuugucaccccuccaucgucucgcuccucaagucaaggcacggugagcacuguuccgaaagaggugcuggauuccuggacaggugcuuucaacacccgaagacagccccucuuugcccacauaaggcggcguggggaaucucgcgucuga

SEQ ID NO: 21849 - RNA, 807 nt, Artificial Sequence
  derived and/or modified sequence opt3 from capsid_protein_VP2__Norovirus__AFX81158
auggccggcgcuuucuuugcagggcuggccagcgacgugcucggauccggucuuggcucucugaucaacgcgggggcuggagccauuaaucagaagauagauuucgagaacaauagaaaauugcaacaggcaucauuucaguucaguagcaacuuacagcaagccuccuuucagcacgacaaggaaaugcugcaggcucagaucgaggcaaccaaaaagcuacaacaggaaaugaugaaagucaagcaggccaugcuccuggagggcgguuucucugaaacagaugcugccaggggagcgauuaaugcacccaugacuaagguucuugacuggucggggacgcgguacugggccccugaugcucgcaccacaacuuauaacgccggccgauuuucaaccccacagccgagcggcacacugcccgggcguaucaauccuagaaccuugacuccagcaaggggaaguuccucuacaagcuccaacgcuucaaccgccacgaguauucauagcaaucaaacugugucuacccggcucgguuccacagcgggcucagggacuaacguaagcagucugcccucuaccgcccgcacaagauccuggguggaggaccagaauaggaaccugagcccuuucaugcggggagcacacaauaucucguuugucaccccacccucuucccgcucaaguagccagggcacgguguccacuguuccuaaagaggugcucgauucuuggacaggugcuuucaacacccgaagacaaccauuauuugcccauauaaggcggcguggggaaagccgcgucuga

SEQ ID NO: 21850 - RNA, 807 nt, Artificial Sequence
  derived and/or modified sequence opt3 from capsid_protein_VP2__Norovirus__AFX81164
auggccggcgcuuucuuugcagggcuggccagcgacgugcucggauccggucuuggcucucugaucaacgcgggggcuggagccauuaaucagaagauagauuucgagaacaauagaaaauugcaacaggcaucauuucaguucaguagcaacuuacagcaagccuccuuucagcacgacaaggaaaugcugcaggcucagaucgaggcaaccaaaaagcuacaacaggaaaugaugaaagucaagcaggccaugcuccuggagggcgguuucucugaaacagaugcugccaggggagcgauuaaugcacccaugacuaagguucuugacuggucggggacgcgguacugggccccugaugcucgcaccacaacuuauaacgccggccgauuuucaaccccacagccgagcggcacacugcccgggcguaucaauccuagaaccccaacucccgcaaggggaaguuccucuacaagcuccaacgcuucaaccgccacgaguauuuacagcaaucaaacugugucuacccgguuggguuccacagcgggcucagggacuaacguaagcagucucccuucuaccgcccgcacaagauccuggguggaggaccagaauaggaaccugagcccauucaugcggggagcacauaauaucucguuugucacgcccccuucuucccgcucaaguagccagggcaccguguccacuguuccaaaagaggugcuggauucuuggacaggugcuuucaacacccgaagacaaccgcucuuugcccacauaaggcggcguggggaaagccgcgucuga

SEQ ID NO: 21851 - RNA, 807 nt, Artificial Sequence; identical to SEQ ID NO: 21842
  derived and/or modified sequence opt3 from capsid_protein_VP2__Norovirus__AFX81173

SEQ ID NO: 21852 - RNA, 807 nt, Artificial Sequence; identical to SEQ ID NO: 21842
  derived and/or modified sequence opt3 from capsid_protein_VP2__Norovirus__AFX81179

SEQ ID NO: 21853 - RNA, 807 nt, Artificial Sequence; identical to SEQ ID NO: 21850
  derived and/or modified sequence opt3 from capsid_protein_VP2__Norovirus__AFX81182

SEQ ID NO: 21854 - RNA, 807 nt, Artificial Sequence
  derived and/or modified sequence opt3 from capsid_protein_VP2__Norovirus__AFX81185
auggccggcgcuuucuuugcagggcuggccagcgacgugcucggauccggucuuggcucucugaucaacgcgggggcuggagccauuaaucagaaggucgauuucgagaacaauagaaaauugcaacaggcaucauuucaguucaguagcaacuuacagcaagccuccuuucagcacgacaaggaaaugcugcaggcucagauagaggcaaccaaaaagcuacaacaggaaaugaugaaaguuaagcaggccaugcuccuggagggcgguuucucugaaacagaugcugccaggggagcgaucaaugcacccaugacuaaggugcuugacuggucggggacgcgguacugggccccugaugcucgcaccacaacuuauaacgccggccgauuuucaaccccacagccgagcggcacacugcccgggcguauuaauccuagaaccccaacucccgcaaggggaaguuccucuacaagcuccaacgcuucaaccgccacgaguauccauagcaaucaaacuguaucuacccgguuggguuccacagcgggcucagggacuaacgugagcagucucccuucuaccgcccgcacaagauccugggucgaggaccagaauaggaaccugagcccauucaugcggggagcacacaauauuucguuugugacgcccccuucuucccgcucaaguagccagggcaccguuuccacugugccaaaagagguccuggauucuuggacaggugcuuucaacacccgaagacaaccgcucuuugcccauaucaggcggcguggggaaagccgcguguga

SEQ ID NO: 21855 - RNA, 807 nt, Artificial Sequence; identical to SEQ ID NO: 21842
  derived and/or modified sequence opt3 from capsid_protein_VP2__Norovirus__AFX81188

SEQ ID NO: 21856 - RNA, 807 nt, Artificial Sequence; identical to SEQ ID NO: 21842
  derived and/or modified sequence opt3 from capsid_protein_VP2__Norovirus__AFX81191

SEQ ID NO: 21857 - RNA, 807 nt, Artificial Sequence
  derived and/or modified sequence opt3 from capsid_protein_VP2__Norovirus__AFX81194
auggccggcgcuuucuuugcagggcuggccagcgacgugcucggauccggucuuggcucucugaucaacgcgggggcuggagccauuaaucagaagauagauuucgagaacaauagaaaauugcaacaggcaucauuucaguucaguagcaacuuacagcaagccuccuuucagcacgacaaggaaaugcugcaggcucagaucgaggcaaccaaaaagcuacaacaggaaaugaugaaagucaagcaggccaugcuccuggagggcgguuucucugaaacagaugcugccaggggagcgauuaaugcacccaugacuaagguucuugacuggucggggacgcgguacugggccccugaugcucgcaccacaacuuauaacgccggccgauuuucaaccccacagccgagcggcacacugcccgggcgugugaauccuagaaccccaacucccgcaaggggaaguuccucuacaagcuccaacgcuucaaucgccaccaguauuuacagcaaucaaacgguaucuacucgguuggguuccaccgcgggcucagggacaaacgugagcagucucccuucuacugcccgcaccagauccugggucgaggaccagaauaggaaccugagcccauucaugcggggagcacauaauaucucguuugugacacccccuucuucccgcucaaguagccagggcaccguuuccacggugccaaaagagguccuggauucuuggacuggugcuuucaacacacgaagacaaccgcucuuugcccacauaaggcggcguggggaaagccgcguguga

SEQ ID NO: 21858 - RNA, 807 nt, Artificial Sequence; identical to SEQ ID NO: 21842
  derived and/or modified sequence opt3 from capsid_protein_VP2__Norovirus__AFX81197

SEQ ID NO: 21859 - RNA, 807 nt, Artificial Sequence
  derived and/or modified sequence opt3 from capsid_protein_VP2__Norovirus__AFX81200
auggccggcgcuuucuuugcagggcuggccagcgacgugcucggauccggucuuggcucucugaucaacgcgggggcuggagccauuaaucagaagauagauuucgagaacaauagaaaauugcaacaggcaucauuucaguucaguagcaacuuacagcaagccuccuuucagcacgacaaggaaaugcugcaggcucagaucgaggcaaccaaaaagcuacaacaggaaaugaugaaagucaagcaggccaugcuccuggagggcgguuucucugaaacagaugcugccaggggagcgauuaaugcacccaugacuaagguucuugacuggucggggacgcgguacugggccccugaugcucgcaccacaacuuauaacgccggccgauuuucaaccccacagccgagcggcacacugcccgggcguaucaauccuagaaccccaacucccgcaaggggaaguuccucuacaagcuccaacgugucaaccgcuacgaguauuuacuugaaucaaacuguaagcacccggcucgguucuacagccggcuccgggacuaacgugucaagccugccuaguaccgcgcgcacaagaucuugggucgaggaccagaauaggaaccuguccccauucaugcggggagcccauaauaucagcuuugugacgcccccuucgucucgcuccucaagucagggcaccguuagcacugugccaaaagagguccucgauuccuggacaggugcauucaacacccgaagacaaccguuauuugcucacauaaggcggcguggggaaucucgcguguga

SEQ ID NO: 21860 - RNA, 807 nt, Artificial Sequence; identical to SEQ ID NO: 21850
  derived and/or modified sequence opt3 from capsid_protein_VP2__Norovirus__AFX81203

SEQ ID NO: 21861 - RNA, 807 nt, Artificial Sequence
  derived and/or modified sequence opt3 from capsid_protein_VP2__Norovirus__AFX81206
auggccggcgcuuucuuugcagggcuggccagcgacgugcucggauccggucuuucuucacugaucaacgcgggcgcuggggccauuaaucagaagauagauuucgagaacaauagaaaauugcaacaggcaaguuuucaguucagcuccaacuuacagcaagccucuuuucagcacgacaaggaaaugcugcaggcucagaucgaggcaaccaaaaagcuacaacaggaaaugaugaaagucaagcaggccaugcuccuggagggaggcuucucggaaacagaugcugccaggggugcgguuaaugcacccaugacuaaggugcuugacuggucagggacgcgguacugggccccugaugcucgcaccacaacuuauaacgccggacgauuuagcaccccacagccgaguggcacacugcccggccguauuaauccuagaaccccaacucccgcaaggggguccucuagcacauccucaaacgcuaguaccgccacgagcaucuacucuaaucaaacuguauccacccgguugggaucaacagcggguagcggcacuaacgugaguucucucccuuccaccgcccgcacaagaagcugggucgaggaccagaauaggaaccugucgccauucaugcgcggggcacauaauauuucuuuugugacgcccccuuccucacggaguagcucccagggaaccguuucuacugugccaaaagagguccuggauagcuggacaggcgcuuucaacacccgaagacaaccgcucuuugcccacaucaggcggcguggugaaucacgcguguga

SEQ ID NO: 21862 - RNA, 807 nt, Artificial Sequence; identical to SEQ ID NO: 21850
  derived and/or modified sequence opt3 from capsid_protein_VP2__Norovirus__AFX81209

SEQ ID NO: 21863 - RNA, 807 nt, Artificial Sequence
  derived and/or modified sequence opt3 from capsid_protein_VP2__Norovirus__AFX81212
auggccggcgcuuucuuugcagggcuggccagcgacgugcucggauccggucuuggcucucugaucaacgcgggggcuggagccauuaaucagaagauagauuucgagaacaauagaaaauugcaacaggcaucauuucaguucaguagcaacuuacagcaagccuccuuucagcacgacaaggaaaugcugcaggcucagaucgaggcaaccaaaaagcuacaacaggaaaugaugaaagucaagcaggccaugcuccuggagggcgguuucucugaaacagaugcugccaggggagcgauuaaugcacccaugacuaagguucuugacuggucggggacgcgguacugggccccugaugcucgcaccacaacuuauaacgccggccgauuuucaaccccacagccgagcggcacacugcccgggcguaucaauccuagaaccccaacucccgcaaggggaaguuccucuacaaccagcaacgcuuccacggccacuucaauucauaguaaucaaaccgugagcacacgguuggguucuacugcgggcuccgggaccaacguaucaagccucccuaguacagcccgcaccagaucuuggguggaggaccagaauaggaaccuguccccauucaugcggggagcacacaauaucagcuuugucacgcccccuucgucucgcuccucaagucagggcacugugagcacaguuccaaaagaggugcuggauuccuggaccggugcuuucaacacucgaagacaaccgcucuuugcccauauaaggcggcguggggaaucucgcgucuga

SEQ ID NO: 21864 - RNA, 807 nt, Artificial Sequence
  derived and/or modified sequence opt3 from capsid_protein_VP2__Norovirus__AFX81215
auggccggcgcuuucuuugcagggcuggccagcgacgugcucggauccggucuuggcucucugaucaacgcgggggcuggagccauuaaucagaagauagauuucgagaacaauagaaaauugcaacaggcaucauuucaguucaguagcaacuuacagcaagccuccuuucagcacgacaaggaaaugcugcaggcucagaucgaggcaaccaaaaagcuacaacaggaaaugaugaaagucaagcaggccaugcuccuggagggcgguuucucugaaacagaugcugccaggggagcgguuaaugcacccaugacuaaggugcuugacuggucggggacgcgguacugggccccugaugcucgcaccacaacuuauaacgccggccgauuuucaaccccacagccgagcggcacacugcccgggcguauuaauccuagaaccccaacucccgcaaggggaaguuccucuacaagcuccaacgcuccuaucgccaccucaauuuacaguaaucaaacgguaagcacucgguuggguucuaccgcgggcuccgggacaaacgugucaagccucccaaguacugcccgcaccagaucuugggucgaggaccagaauaggaaccugucccccuucaugcggggagcacauaauaucagcuuugugacaccuccaucgucucgcuccucaagucagggcaccguuagcacggugccgaaagagguccuggauuccuggacuggugcuuucaacacacgaagacaaccccucuuugcccacauaaggcggcguggggaaucucgcguguga

SEQ ID NO: 21865 - RNA, 807 nt, Artificial Sequence; identical to SEQ ID NO: 21850
  derived and/or modified sequence opt3 from capsid_protein_VP2__Norovirus__AFX81218

SEQ ID NO: 21866 - RNA, 807 nt, Artificial Sequence
  derived and/or modified sequence opt3 from capsid_protein_VP2__Norovirus__AFX81221
auggccggcgcuuucuuugcagggcuggccagcgacgugcucggauccggucuuggcucucugaucaacgcgggggcuggagccauuaaucagaagauagauuucgagaacaauagaaaauugcaacaggcaucauuucaguucaguagcaacuuacagcaagccuccuuucagcacgacaaggaaaugcugcaggcucagaucgaggcaaccaaaaagcuacaacaggaaaugaugaaagucaagcaggccaugcuccuggagggcgguuucucugaaacagaugcugccaggggagcgauuaaugcacccaugacuaagguucuugacuggucggggacgcgguacugggccccugaugcucgcaccacaacuuauaacgccggccgauuuucaaccccacagccgagcggcacacugcccgggcguaucaauccuagaaccccaacucccgcaaggggaaguccuuccacaucuagcaacgcuuccaccgccacgucaauuuacaguaaucaaacugugagcacccgguuggguucuacagcgggcuccgggacuaacguaucaagccucccaaguaccgcccgcacaagaucuuggguggaggaccagaauaggaaccugucccccuucaugcggggagcacauaauaucagcuuugucaccccuccaucgucucgcuccucaagucagggcacggugagcacuguuccgaaagaggugcuggauuccuggacaggugcuuucaacacccgaagacaaccccucuuugcccacauaaggcggcguggggaaucucgcgucuga

SEQ ID NO: 21867 - RNA, 807 nt, Artificial Sequence; identical to SEQ ID NO: 21850
  derived and/or modified sequence opt3 from capsid_protein_VP2__Norovirus__AFX81224

SEQ ID NO: 21868 - RNA, 807 nt, Artificial Sequence; identical to SEQ ID NO: 21850
  derived and/or modified sequence opt3 from capsid_protein_VP2__Norovirus__AFX81227

SEQ ID NO: 21869 - RNA, 807 nt, Artificial Sequence
  derived and/or modified sequence opt3 from capsid_protein_VP2__Norovirus__AFX81230
auggccggcgcuuucuuugcagggcuggccagcgacgugcucggauccggucuuggcucucugaucaacgcgggggcuggagccauuaaucagaagauagauuucgagaacaauagaaaauugcaacaggcaucauuucaguucaguagcgacuuacagcaagccuccuuucagcacgauaaggaaaugcugcaggcucagaucgaggcaaccaaaaagcuacaacaggaaaugaugaaagucaagcaggccaugcuccuggagggcgguuucucugaaacagacgcugccaggggagcgauuaacgcacccaugacuaagguucuugauuggucggggacgcgguacugggccccugacgcucgcaccacaacuuauaaugccggccgauuuucaaccccacagccgagcggcacacugcccgggcguaucaacccuagaaccccagcacccgcuaggggaaguuccucuacuagcuccaaugccucaacagcgaccaguauuuacagcaaccaaacggugucuacucgguuggguuccaccgccggcucagggacaaauguaagcagucucccuucuacugcacgcaccagauccuggguggaggaucagaacaggaaucugagcccauucaugcggggagcucauaacaucucguuugucacacccccuucuucccgcucaaguagccagggcaccguguccacgguuccaaaagaggugcuggacucuuggacuggugccuucaauacacgaagacaaccgcucuuugcucacauaaggcggcguggggaaagccgcgucuga

SEQ ID NO: 21870 - RNA, 807 nt, Artificial Sequence
  derived and/or modified sequence opt3 from capsid_protein_VP2__Norovirus__AFX81233
auggccggcgcuuucuuugcagggcuggccagcgacgugcucggauccggucuuggcucucugaucaacgcgggggcuggagccauuaaucagaagauagauuucgagaacaauagaaaauugcaacaggcaucauuucaguucaguagcaacuuacagcaagccuccuuucagcacgacaaggaaaugcugcaggcucagaucgaggcaaccaaaaagcuacaacaggaaaugaugagggucaaacaggccaugcuccuggagggcgguuucucugaaacagaugcugcccgcggggcgauuaaugcacccaugacuaagguucuugacuggucgggaacgcgguacugggccccugaugcucgaaccacaacuuauaacgccggccguuuuucaaccccacagccgagcggcacacugcccgggagaaucaauccuaggaccccaacucccgcacggggaaguuccucuacaagcuccaacgugucaaccgcuacgaguauuuacagcaaucaaacuuucucuacccgcuuggguuccacagccggcucagggacuaacguaagcagucucccuucuaccgcgagaacaagguccuggguggaggaccagaaucggaaccugagcccauuuaugcgcggagcccauaauaucucguucgucaccccgccuucuucccgaucaaguagccagggcacgguguccacuguuccaaaggaggugcuggauucuuggacaggugcauuuaacaccagaaggcaaccccucuucgcucacauacggcgucgcggggaaagcagagucuga

SEQ ID NO: 21871 - RNA, 807 nt, Artificial Sequence
  derived and/or modified sequence opt3 from capsid_protein_VP2__Norovirus__AFX81239
auggccggcgcuuucuuugcagggcuggccagcgacgugcucggauccggucuuggcucucugaucaacgcgggggcuggagccauuaaucagaagauagauuucgagaacaauagaaaauugcaacaggcaucauuucaguucaguagcaacuuacagcaagccuccuuucagcacgacaaggaaaugcugcaggcucagaucgaggcaaccaaaaagcuacaacaggaaaugaugaaagucaagcaggccaugcuccuggagggcgguuucucugaaacagaugcugccaggggagcgauuaaugcacccaugacuaagguucuugacuggucggggacgcgguacugggccccugaugcucgcaccacaacuuauaacgccggccgauuuucaaccccacagccgagcggcacacugcccgggcguaucaauccuagaaccccaacucccgcaaggggaaguuccucuacaagcuccaacgugucaaccgcuacgaguauuuacagcaaucaaacugccucuacccgguuggguuccacagcgggcucagggacuaacguaagcagucucccuucuaccgcccgcacaagauccuggguggaggaccagaauaggaaccugagcccauucaugcggggagcacauaauaucucguuugucacgcccccuucuucccgcucaaguagccagggcaccguguccacuguuccaaaagaggugcuggauucuuggacaggugcuuucaacacccgaagacaaccgcucuuugcccacauaaggcggcguggggaaagccgcgucuga

SEQ ID NO: 21872 - RNA, 807 nt, Artificial Sequence
  derived and/or modified sequence opt3 from capsid_protein_VP2__Norovirus__AFX81242
auggccggcgcuuucuuugcagggcuggccagcgacgugcucggauccggucuuggcucucugaucaacgcgggggcuggagccauuaaucagaaggucgaguucgaaaacaauagaaaauugcaacaggcaucauuucaguucaguagcaacuuacagcaagccuccuuucagcacgauaaggagaugcugcaggcucagauagaagcaaccaaaaagcuacaacaggagaugaugaggguuaaacaggccaugcuccuggaaggcgguuucucugagacagacgcugcccgcggggcgaucaaugcacccaugacuaagacgcuugauuggaccggaacacgguacugggccccugacgcucgaacuaccacauauaacgccggccguuuuucgaccccacagccgucaggcgcacugcccgggagagcuaauuugagggccacugugccugcgcggggaagcaguuccacauucucuaacagcuccauugccaccucaguauacaguaaucaaacgacuagcacccgccucgguucuacagcaggcuccgggacuucagugagcagucugccaucuaccgcuagaacaagguccugggucgaggaucagaaccggaaucugagccccuuuaugcgcggagcccauaacaucucguucgugaccccuccaucuucccgaucaaguagccagggcacgguuuccacugugcccaaggaaguccucgacucuuggacaggugcuuuuaauaccagaaggcaaccuuuauucgcccacauucggaaacguggggagagccgcguguga

SEQ ID NO: 21873 - RNA, 807 nt, Artificial Sequence
  derived and/or modified sequence opt3 from capsid_protein_VP2__Norovirus__AFX81245
auggccggcgcuuucuuugcagggcuggccagcgacgugcucggauccggucuuggcucucugaucaacgcgggggcuggagccauuaaucagaaggucgaguucgaaaacaauagaaaauugcaacaggcaucauuucaguucaguagcuccuuacagcaagccucuuuucagcacgauaaggagaugcugcaggcucagauagaagcaaccaaaaagcuacaacaggagaugaugaggguuaaacaggccaugcuccuggaaggcgguuucucggagacagacgcugcccgcggggcgaucaacgcacccaugacuaagacgcuugauuggucaggaacccgguacugggccccugacgcucgaacaacuaccuauaaugccggccguuuuagcacaccacagccgaguggcgcacugcccgggagagcuaacuugagggccaccgugccugcgcggggauccucuagcacuuccucaaauaguagcauugccacaucuguauacuccaaccaaaccacgucaacucgccucgguagcaccgcaggcagugggacaucuguguccagccugccaucgacugcuagaaccaggucuugggucgaggaucagaaucggaaccugucccccuucaugcgcggagcccauaauaucucauuugugacaccuccaaguagccgauccucuagccagggcaccguuucaacggugcccaaggaaguccucgacaguuggacuggugcuuucaacacaagaaggcaaccuuuauuugcccacauucggaaacguggggagucccgcguguga

SEQ ID NO: 21874 - RNA, 807 nt, Artificial Sequence
  derived and/or modified sequence opt3 from capsid_protein_VP2__Norovirus__AFX81248
auggccggcgcuuucuuugcagggcuggccagcgacgugcucggauccggucuuggcucucugaucaacgcgggggcuggagccauuaaucagaaggucgaguucgaaaacaauagaaaauugcaacaggcaucauuucaguucaguagcaacuuacagcaagccuccuuucagcacgauaaggagaugcugcaggcucagauagaagcaaccaggaaacuacaacaggagaugaugcggguuaagcaggccaugcuccuggaaggcgguuucucugagacagacgcugcccgcggggcgaucaaugcacccaugacuaaaacgcuugauuggucgggaacccgauacugggccccugacgcucguacaacuaccuauaacgccggcagauuuucaacaccacagccgagcggcgcacugcccgggagggcuaauuugcgggccaccgugccugcgcgcggaaguuccucuacuuucagcaacuccucaauugccacaaguguauacagcaaucaaaccacgucuacuagacucgguuccaccgcaggcucagggacaagcgugaguucucugccauccacugcuaggacccggagcugggucgaggaucagaaccgcaaucugucgcccuuuaugcgaggagcccauaacaucucuuucgugacaccuccauccucaagaaguagcucccagggcaccguuucuacggugcccaaggaaguccucgacagcuggacuggugcuuuuaauacaaggcggcaaccuuuauucgcccacauucguaagcgcggggagucaagaguguga

SEQ ID NO: 21875 - RNA, 807 nt, Artificial Sequence
  derived and/or modified sequence opt3 from capsid_protein_VP2__Norovirus__AFX81251
auggccggcgcuuucuuugcagggcuggccagcgacgugcucggauccggucuuggcucucugaucaacgcgggggcuggagccauuaaucagaaggucgaguucgaaaacaauagaaaauugcaacaggcaucauuucaguucaguagcaacuuacagcaagccuccuuucagcacgauaaggagaugcugcaggcucagauagaagcaaccaaaaagcuacaacaggagaugaugaggguuaaacaggccaugcuccuggaaggcgguuucucugagacagacgcugcccgcggggcgaucaaugcacccaugacuaagacgcuugauuggucgggaacccgguacugggccccugacgcucgaacaacuaccuauaacgccggccguuuuucaacaccacagccgagcggcgcacugcccgggagagcuaauuugagggccaccgugccugcgcggggaaguuccucuacuuucagcaacuccucaauugccacaaguguauacagcaaucaaaccacgucuacucgccucgguuccaccgcaggcucaggggcuagcgugaguucucugccauccacagccagaacuaggagcugggucgaggaucagaaccggaaucugucgcccuuuaugcgcggagcucauaacaucucuuucgugaccccuccauccucacgaaguagcucccagggcacaguuucuaccgugcccaaggaaguccucgacagcuggacgggugccuuuaauacuagaaggcaaccuuuauucgcacacauucggaaacguggggagucacgcguguga

SEQ ID NO: 21876 - RNA, 807 nt, Artificial Sequence
  derived and/or modified sequence opt3 from capsid_protein_VP2__Norovirus__AFX81254
auggccggcgcuuucuuugcagggcuggccagcgacgugcucggauccggucuuggcucucugaucaacgcgggggcuggagccauuaaucagaccgucgaguucgaaaacaauagaaaguugcaacaggcaucauuucaguucaguagcaacuuacagcaagccuccuuucagcacgauaaagagaugcugcaggcucagauagaagcaacaaagaaacuacaacaggagaugaugaggguuaagcaggccaugcuccuggaaggcgguuucucugagacugacgcugcccgcggggcgaucaaugcacccaugacgaaaacccuugauuggacaggaacucgguacugggccccugacgcucgaaccacaaccuauaacgccggccguuuuucgacuccacagccgucaggcgcacugcccgggagagcuaauuugagggccacagugccugcgcggggaagcaguuccaccuucucuaacagcuccauugccacgucaguauacaguaaucaaacuaccagcacacgccucgguucuacugcaggcuccgggaccucagugagcagucugccaucuacagcuagaaccagguccugggucgaggaucagaaccggaaucugagccccuuuaugcgcggagcccauaacaucucguucgugacgccuccaucuucccgaucaaguagccagggcacuguuuccacagugcccaaggaaguccucgacucuuggaccggugcuuuuaauacuagaaggcaaccuuuauucgcccacauucggaagcguggggagagccgcguguga

SEQ ID NO: 21877 - RNA, 807 nt, Artificial Sequence
  derived and/or modified sequence opt3 from capsid_protein_VP2__Norovirus__AFX81257
auggccggcgcuuucuuugcagggcuggccagcgacgugcucggauccggucuuggcucucugaucaacgcgggggcuggagccauuaaucagaaggucgaguucgaaaacaauagaaaauugcaacaggcaucauuucaguucaguagcuccuuacagcaagccucuuuucagcacgauaaggagaugcugcaggcucagauagaagcaaccaaaaagcuacaacaggagaugaugaggguuaaacaggccaugcuccuggaaggcgguuucucggagacagacgcugcccgcggggcgaucaacgcacccaugacuaagacgcuugauuggucaggaacccgguacugggccccugacgcucgaacaacuaccuauaaugccggccguuuuagcacaccacagccgaguggcgcacugcccgggagagcuaacuugagggccaccgugccugcgcggggauccucuagcacuuccucaaauaguagcauugccacaucuguauacuccaaccaaaccacgucaacucgccucgguagcaccgcaggcagugggacaucuguguccagccauccaucgacugcuagaaccaggucuugggucgaggaucagaaucggaaccugucccccuucaugcgcggagcccacaauaucucauuugugacaccuccaaguagccgauccucuagccagggcaccguuucaacggugcccaaggaaguccuggacaguuggacuggugcuuucaacacaagaaggcaaccucucuuugcccauauucggaaacguggggagucccgcguguga

SEQ ID NO: 21878 - RNA, 807 nt, Artificial Sequence
  derived and/or modified sequence opt3 from capsid_protein_VP2__Norovirus__AFX81260
auggccggcgcuuucuuugcagggcuggccagcgacgugcucggauccggucuuggcucucugaucaacgcgggggcuggagccauuaaucagaagauagauuucgagaacaauagaaaauugcaacaggcaucauuucaguucaguagcaacuuacagcaagccuccuuucagcacgacaaggaaaugcugcaggcucagaucgaggcaaccaaaaagcuacaacaggaaaugaugaaagucaagcaggccaugcuccuggagggcgguuucucugaaacagaugcugccaggggagcgauuaaugcacccaugacuaagguucuugacuggucggggacgcgguacugggccccugaugcucgcaccacaacuuauaacgccggccgauuuucaaccccacagccgagcggcacacugcccgggcguaucaauccuagaaccccaacucccgcaaggggaaguuccucuacaagcuccaacgcuucaaccgccacgaguauucauagcaaucaaacugugucuacccgguuggguuccacagcgggcucagggacuaacguaagcagucucccuucuaccgcccgcacaagauccuggguggaggaccagaauaggaaccugagcccauucaugcggggagcacacaauaucucguuugucacgcccccuucuucccgcucaaguagccagggcaccguguccacuguuccaaaagaggugcuggauucuuggacaggugcuuucaacacccgaagacaaccgcucuuugcccauacuaggcggcguggggaaagccgcgucuga

SEQ ID NO: 21879 - RNA, 807 nt, Artificial Sequence; identical to SEQ ID NO: 21850
  derived and/or modified sequence opt3 from capsid_protein_VP2__Norovirus__AFX81263

SEQ ID NO: 21880 - RNA, 807 nt, Artificial Sequence; identical to SEQ ID NO: 21850
  derived and/or modified sequence opt3 from capsid_protein_VP2__Norovirus__AFX81269

SEQ ID NO: 21881 - RNA, 807 nt, Artificial Sequence; identical to SEQ ID NO: 21842
  derived and/or modified sequence opt3 from capsid_protein_VP2__Norovirus__AFX81272

SEQ ID NO: 21882 - RNA, 807 nt, Artificial Sequence; identical to SEQ ID NO: 21850
  derived and/or modified sequence opt3 from capsid_protein_VP2__Norovirus__AFX81275

SEQ ID NO: 21883 - RNA, 807 nt, Artificial Sequence; identical to SEQ ID NO: 21850
  derived and/or modified sequence opt3 from capsid_protein_VP2__Norovirus__AFX81278

SEQ ID NO: 21884 - RNA, 807 nt, Artificial Sequence
  derived and/or modified sequence opt3 from capsid_protein_VP2__Norovirus__AFX81281
auggccggcgcuuucuuugcagggcuggccagcgacgugcucggauccggucuuggcucucugaucaacgcgggggcuggagccauuaaucagaagauagauuucgagaacaauagaaaauugcaacaggcaucauuucaguucaguagcaacuuacagcaagccuccuuucagcacgacaaggaaaugcugcaggcucagaucgaggcaaccaaaaagcuacaacaggaaaugaugaaagucaagcaggccaugcuccuggagggcgguuucucugaaacagaugcugccaggggagcgauuaaugcacccaugacuaagguucuugacuggucggggacgcgguacugggccccugaugcucgcaccacaacuuauaacgccggccgauuuucaaccccacagccgagcggcgcacugcccgggcguaucaauccuagaacaccaacccccgcuaggggaaguuccucuacuagcuccaacgccucaacagcgaccaguauucauagcaaucaaacggugucuacucgguuggguuccaccgccggcucagggacaaacguaagcagucucccuucuacugcacgcaccagauccuggguggaggaccagaauaggaaccugagcccauucaugcggggagcucacaauaucucguuugucacacccccuucuucccgcucaaguagccagggcaccguguccacgguuccaaaagaggugcuggauucuuggacuggugccuucaacacacgaagacaaccgcucuuugcucauauaaggcggcguggggaaagccgcgucuga

SEQ ID NO: 21885 - RNA, 807 nt, Artificial Sequence; identical to SEQ ID NO: 21850
  derived and/or modified sequence opt3 from capsid_protein_VP2__Norovirus__AFX81284

SEQ ID NO: 21886 - RNA, 807 nt, Artificial Sequence
  derived and/or modified sequence opt3 from capsid_protein_VP2__Norovirus__AFX81287
auggccggcgcuuucuuugcagggcuggccagcgacgugcucggauccggucuuucuucacugaucaacgcgggcgcuggggccauuaaucagaagauagauuucgagaacaauagaaaauugcaacaggcaaguuuucaguucagcuccaacuuacagcaagccucuuuucagcacgacaaggaaaugcugcaggcucagaucgaggcaaccaaaaagcuacaacaggaaaugaugaaagucaagcaggccaugcuccuggagggaggcuucucggaaacagaugcugccaggggugcgauuaaugcacccaugacuaagguucuugacuggucagggacgcgguacugggccccugaugcucgcaccacaacuuauaacgccggacgauuuagcaccccacagccgaguggcacacugcccggccguaucaauccuagaaccccaacucccgcaaggggguccucuagcacauccucaaacgcuccuaccgccacgaguauucauagcaaucaaacugugucuacccgguugggauccacagcggguucaggcacuaacguaagcagucucccaucuaccgcccgcacaagauccuggguggaggaccagaauaggaaccugagccccuucaugcgcggggcacacaauaucucguuugucaccccuccaucuucccggucaaguagccagggaacgguguccacuguuccgaaagaggugcuggauucuuggacaggcgcuuucaacacccgaagacaaccccucuuugcccauauaaggcggcguggugaaagccgcgucuga

SEQ ID NO: 21887 - RNA, 807 nt, Artificial Sequence; identical to SEQ ID NO: 21850
  derived and/or modified sequence opt3 from capsid_protein_VP2__Norovirus__AFX81290

SEQ ID NO: 21888 - RNA, 807 nt, Artificial Sequence; identical to SEQ ID NO: 21842
  derived and/or modified sequence opt3 from capsid_protein_VP2__Norovirus__AFX81293

SEQ ID NO: 21889 - RNA, 807 nt, Artificial Sequence
  derived and/or modified sequence opt3 from capsid_protein_VP2__Norovirus__AFX81296
auggccggcgcuuucuuugcagggcuggccagcgacgugcucggauccggucuuggcucucugaucaacgcgggggcuggagccauuaaucagaagauagauuucgagaacaauagaaaauugcaacaggcaucauuucaguucaguagcaacuuacagcaagccuccuuucagcacgacaaggaaaugcugcaggcucagaucgaggcaaccaaaaagcuacaacaggaaaugaugaaagucaagcaggccaugcuccuggagggcgguuucucugaaacagaugcugccaggggagcgauuaaugcacccaugacuaagguucuugacuggucggggacgcgguacugggccccugaugcucgcaccacaacuuauaacgccggccgauuuucaaccccacagccgagcggcacacugcccgggcgugugaauccuagaaccccaacucccgcaaggggaaguuccucuacaagcuccaacgcuucaaccgccacgaguauccauagcaaucaaacuguaucuacccgguuggguuccacagcgggcucagggacuaacgugagcagucucccuucuaccgcccgcacaagauccugggucgaggaccagaauaggaaccugagcccauucaugcggggagcacacaauauuucguuugugacgcccccuucuucccgcucaaguagccagggcaccguuuccacugugccaaaagagguccuggauucuuggacaggugcuuucaacacccgaagacaaccgcucuuugcccauaucaggcggcguggggaaagccgcguguga

SEQ ID NO: 21890 - RNA, 807 nt, Artificial Sequence
  derived and/or modified sequence opt3 from capsid_protein_VP2__Norovirus__AFX81299
auggccggcgcuuucuuugcagggcuggccagcgacgugcucggauccggucuuggcucucugaucaacgcgggggcuggagccauuaaucagaagauagauuucgagaacaauagaaaauugcaacaggcaucauuucaguucaguagcaacuuacagcaagccuccuuucagcacgacaaggaaaugcugcaggcucagaucgaggcaaccaaaaagcuacaacaggaaaugaugaaagucaagcaggccaugcuccuggagggcgguuucucugaaacagaugcugccaggggagcgauuaaugcacccaugacuaagguucuugacuggucggggacgcgguacuggaccccugaugcccgcacaacuaccuauaacgcuggccgauuuucaacaccacagccgagcggcacccugcccgggcguaucaauccuagaacuccaacacccgccaggggaaguuccucuaccagcuccaacgcaucaacggcuaccaguauucauagcaaucaaacugugucuacacgguuggguuccacugccggcucagggaccaacguaagcagucucccuucuacagcgcgcaccagauccuggguggaggaccagaauaggaaccugagcccauucaugcggggagcccacaauaucucguuugucacgcccccuucuucccgcucaaguagccagggcacuguguccacaguuccaaaagaggugcuggauucuuggaccggugcauucaacacucgaagacaaccgcucuuugcucauauaaggcggcguggggaaagccgcgucuga

SEQ ID NO: 21891 - RNA, 807 nt, Artificial Sequence
  derived and/or modified sequence opt3 from capsid_protein_VP2__Norovirus__AFX81302
auggccggcgcuuucuuugcagggcuggccagcgacgugcucuccucuggacuugguucacugaucaacgcgggcgcuggggccauuaaucagaagauagauuucgagaacaauagaaaauugcaacaggcaaguuuucaguucagcuccaacuuacagcaagccucuuuucagcacgacaaggaaaugcugcaggcucagaucgaggcaaccaaaaagcuacaacaggaaaugaugaaagucaagcaggccaugcuccuggagggaggcuucucggaaacagaugcugccaggggugcgauuaaugcacccaugacuaaggcccuugacuggucagggacgcgguacugggcuccugaugcccgcaccacaacuuauagcgcaggacgauuuaguaccccacagccguccggcgcucugcccggccguacaaacccuagagccccaauccccgcgagggggucuccuagcaccuccucaggagccaguacugcaacaagcauuuacucuaaucaaaccguuuccacgcgguuggguucaacugcuggcagcgggaccaacgugaguucucucccauccacagcccgcacuagaagcuggguagaggaccagaauaggaaccugucgcccuucaugcggggagcucauaauaucucuuuugugaccccuccauccucacgcaguagcucccagggcacagucucuaccgugccgaaagagguucuggauagcuggacgggugccuucaacacucgaagacaaccccucuuugcacacauaaggcggcguggggaaucacgcguguga

SEQ ID NO: 21892 - RNA, 807 nt, Artificial Sequence
  derived and/or modified sequence opt3 from capsid_protein_VP2__Norovirus__AFX81305
auggccggcgcuuucuuugcagggcuggccagcgacgugcucggauccggucuuggcucucugaucaacgcgggggcuggagccauuaaucagaagauagauuucgagaacaauagaaaauugcaacaggcaucauuucaguucaguagcgacuuacagcaagccuccuuucagcacgauaaggaaaugcugcaggcucagaucgaggcaaccaaaaagcuacaacaggaaaugaugaaagucaagcaggccaugcuccuggagggcgguuucucugaaacagacgcugccaggggagcgauuaacgcacccaugacuaagguucuugauuggucggggacgcgguacugggccccugacgcucgcaccacaacuuauucagccggccgauuuagcaccccacagccgaguggcacacugcccgggcguaccaauccuagaacuccaacacccgcaaggggauccucuagcaccuccucaaacgcuaguacggccacuagcauccauucuaaucaaaccguguccacacgguuggguucaacugcgggcagcgggaccaacguaaguucucucccuuccacagcccgcaccagaagcuggguggaggaucagaauaggaaccugucgccauucaugcggggagcacacaauauuucuuuugucacgcccccuuccucacgcaguagcucccagggcacugugucuacaguuccaaaagaggugcuggacagcuggaccggugcuuucaacacucgaagacaaccgcucuuugcccauaucaggcggcguggggaaucacgcgucuga

SEQ ID NO: 21893 - RNA, 807 nt, Artificial Sequence; identical to SEQ ID NO: 21842
  derived and/or modified sequence opt3 from capsid_protein_VP2__Norovirus__AFX81308

SEQ ID NO: 21894 - RNA, 807 nt, Artificial Sequence; identical to SEQ ID NO: 21850
  derived and/or modified sequence opt3 from capsid_protein_VP2__Norovirus__AFX81311

SEQ ID NO: 21895 - RNA, 807 nt, Artificial Sequence; identical to SEQ ID NO: 21842
  derived and/or modified sequence opt3 from capsid_protein_VP2__Norovirus__AFX81314

SEQ ID NO: 21896 - RNA, 807 nt, Artificial Sequence; identical to SEQ ID NO: 21842
  derived and/or modified sequence opt3 from capsid_protein_VP2__Norovirus__AFX81317

SEQ ID NO: 21897 - RNA, 807 nt, Artificial Sequence; identical to SEQ ID NO: 21842
  derived and/or modified sequence opt3 from capsid_protein_VP2__Norovirus__AFX81320

SEQ ID NO: 21898 - RNA, 807 nt, Artificial Sequence
  derived and/or modified sequence opt3 from capsid_protein_VP2__Norovirus__AFX81323
auggccggcgcuuucuuugcagggcuggccagcgacgugcucggauccggucuuggcucucugaucaacgcgggggcuggagccauuaaucagaagauagauuucgagaacaauagaaaauugcaacaggcaucauuucaguucaguagcaacuuacagcaagccuccuuucagcacgacaaggaaaugcugcaggcucagaucgaggcaaccaaaaagcuacaacaggaaaugaugaaagucaagcaggccaugcuccuggagggcgguuucucugaaacagaugcugccaggggagcgauuaaugcacccaugacuaagguucuugacuggucggggacgcgguacugggccccugaugcucgcaccacaacuuauucagccggccgauuuagcaccccacagccgaguggcacacugcccgggcguaucaacccuagaaccccaacucccgcaaggggauccucuagcacauccucaaaugcuaguaccgccacgagcauucauucuaaccaaacuguguccacccgguuggguucaacagcgggcagcgggacuaauguaaguucucucccuuccaccgcccgcacaagaagcuggguggaggaccagaacaggaaucugucgccauucaugcggggagcacacaacaucucuuuugucacgcccccuuccucacgcaguagcucccagggcaccgugucuacuguuccaaaagaggugcuggauagcuggacaggugcuuucaauacccgaagacaaccgcucuuugcccauauaaggcggcguggggaaucacgcgucuga

SEQ ID NO: 21899 - RNA, 807 nt, Artificial Sequence; identical to SEQ ID NO: 21850
  derived and/or modified sequence opt3 from capsid_protein_VP2__Norovirus__AFX81326

SEQ ID NO: 21900 - RNA, 807 nt, Artificial Sequence; identical to SEQ ID NO: 21842
  derived and/or modified sequence opt3 from capsid_protein_VP2__Norovirus__AGE89434

SEQ ID NO: 21901 - RNA, 807 nt, Artificial Sequence; identical to SEQ ID NO: 21842
  derived and/or modified sequence opt3 from capsid_protein_VP2__Norovirus__AGE89437

SEQ ID NO: 21902 - RNA, 807 nt, Artificial Sequence
  derived and/or modified sequence opt3 from capsid_protein_VP2__Norovirus__AGE89440
auggccggcgcuuucuuugcagggcuggccagcgacgugcucggauccggucuuggcucucugaucucagcgggggcuggagccauuaaccagaaggucgaguucgaaaauaacagaaaauugcaacaggcaaguuuucaguucagcuccaauuuacagcaagccucuuuucagcacgauaaggagaugcugcaggcucagauagaagcaaccaaaaagcuacaacaggagaugaugaggguuaaacaggccaugcuccuggaaggcgguuucucggagacagacgcugcccgcggggcgaucaacgcacccaugacuaagacgcuugauuggucaggaacccgguacugggccccugacgcucgaacaacuaccuauaaugccggccguuuuagcacaccacagccgaguggcgcacugcccgggagagcuaacuugagggccaccgugccugcgcggggauccucuagcacuuucuccaauucaaguauugccacaagcguauacucuaaccaaaccacguccacucgccucgguucaaccgcaggcagcgggacaagugugucuucccugccaagcacugcuagaaccaggucgugggucgaggaucagaaucggaaccugucucccuuuaugcgcggagcccauaauaucuccuucgugacaccuccaucaagucgaagcuccucucagggcaccguuagcacggugcccaaggaaguccucgacucauggacuggugcuuuuaacacaagaaggcaaccuuuauucgcccacauucggaaacguggggagagucgcguguga

SEQ ID NO: 21903 - RNA, 807 nt, Artificial Sequence
  derived and/or modified sequence opt3 from capsid_protein_VP2__Norovirus__AGE89443
auggccggcgcuuucuuugcagggcuggccagcgacgugcucggauccggucuuggcucucugaucaacgcgggggcuggagccauuaaucagaaggucgaguucgaaaacaauagaaaauugcaacaggcaucauuucaguucaguagcaacuuacagcaagccuccuuucagcacgauaaggagaugcugcaggcucagauagaagcaaccaaaaagcuacaacaggagaugaugaggguuaaacaggccaugcuccuggaaggcgguuucucugagacagacgcugcccgcggggcgaucaaugcacccaugacuaagacgcuugauuggucgggaacccgguacugggccccugacgcucgaacaacuaccuauaacgccggccguuuuucaacaccacagccgagcggcgcacugcccgggagagcuaauuugagggccaccgugccugcgcggggaaguuccucuacuagcuccaacgccucaauugcaacaaguguauacagcaaucaaaccacgucuacucgccucgguuccaccgcuggcucagggacaagcgugaguucucugccauccacugccagaaccaggagcugggucgaggaucagaaccggaaucugucgcccuucaugcgcggagcucauaacaucucuuuugugacaccuccauccucacgaaguagcucccagggcaccguuucuacggugcccaaggaaguccucgacagcuggacuggugccuucaauacaagaaggcaaccuuuauuugcacacauucggaaacguggggagucacgcguguga

SEQ ID NO: 21904 - RNA, 807 nt, Artificial Sequence
  derived and/or modified sequence opt3 from capsid_protein_VP2__Norovirus__AGE89449
auggccggcgcuuucuuugcagggcuggccagcgacgugcucggauccggucuuggcucucugaucaacgcgggggcuggagccauuaaucagaaggucgaguucgaaaacaauagaaaauugcaacaggcaucauuucaguucaguagcaacuuacagcaagccuccuuucagcacgauaaggagaugcugcaggcucagauagaagcaaccaaaaagcuacaacaggagaugaugaggguuaaacaggccaugcuccuggaaggcgguuucucugagacagacgcugcccgcggggcgaucaaugcacccaugacuaagacgcuugauuggucgggaacccgguacugggccccugacgcucgaacaacuaccuauaacgccggccguuuuucaacaccacagccgagcggcgugcugcccgggagagcaaauuugagggcuaccguaccugcccggggaaguuccucuacuuucagcaacuccucaauugcgacaaguguguacagcaaucaaaccacgucuacucgccucgguuccaccgccggcucagggacaagcgucaguucucugccauccacugcaagaaccaggagcuggguggaggaucagaaccggaaucugucgcccuuuaugcgcggagcucauaacaucucuuucguuacaccuccauccucacgaaguagcucccagggcaccgugucuacgguccccaaggaagugcucgacagcuggacuggugccuuuaauacaagaaggcaaccuuuauucgcucacauucggaaacguggggagucacgcguauga

SEQ ID NO: 21905 - RNA, 807 nt, Artificial Sequence; identical to SEQ ID NO: 21884
  derived and/or modified sequence opt3 from capsid_protein_VP2__Norovirus__AGE89455

SEQ ID NO: 21906 - RNA, 807 nt, Artificial Sequence; identical to SEQ ID NO: 21842
  derived and/or modified sequence opt3 from capsid_protein_VP2__Norovirus__AGE89458

SEQ ID NO: 21907 - RNA, 807 nt, Artificial Sequence; identical to SEQ ID NO: 21850
  derived and/or modified sequence opt3 from capsid_protein_VP2__Norovirus__AGE89461

SEQ ID NO: 21908 - RNA, 807 nt, Artificial Sequence
  derived and/or modified sequence opt3 from capsid_protein_VP2__Norovirus__AGE89464
auggccggcgcuuucuuugcagggcuggccagcgacgugcucggauccggucuuggcucucugaucaacgcgggggcuggagccauuaaucagaagauagauuucgagaacaauagaaaauugcaacaggcaucauuucaguucaguagcaacuuacagcaagccuccuuucagcacgacaaggaaaugcugcaggcucagaucgaggcaaccaaaaagcuacaacaggaaaugaugaaagucaagcaggccaugcuccuggagggcgguuucucugaaacagaugcugccaggggagcgauuaaugcacccaugacuaagguucuugacuggucggggacgcgguacugggccccugaugcucgcaccacaacuuauaacgccggccgauuuucaaccccacagccgagcggcacacugcccgggcguaucaauccuagaaccccaacucccgcaaggggaaguuccucuacaccuagcaacgcuuccaccgccacgucaauucauaguaaucaaacugugagcacccgguuggguucuacagcgggcuccgggacuaacguaucaagccucccaaguaccgcccgcacaagaucuuggguggaggaccagaauaggaaccugucccccuucaugcggggagcacacaauaucagcuuugucaccccuccaucgucucgcuccucaagucagggcacggugagcacuguuccgaaagaggugcuggauuccuggacaggugcuuucaacacccgaagacaaccccucuuugcccauauaaggcggcguggggaaucucgcgucuga

SEQ ID NO: 21909 - RNA, 807 nt, Artificial Sequence; identical to SEQ ID NO: 21842
  derived and/or modified sequence opt3 from capsid_protein_VP2__Norovirus__AGE89467

SEQ ID NO: 21910 - RNA, 807 nt, Artificial Sequence
  derived and/or modified sequence opt3 from capsid_protein_VP2__Norovirus__AGE89470
auggccggcgcuuucuuugcagggcuggccagcgacgugcucggauccggucuuggcucucugaucaacgcgggggcuggagccauuaaucagaagauagauuucgagaacaauagaaaauugcaacaggcaucauuucaguucaguagcaacuuacagcaagccuccuuucagcacgacaaggaaaugcugcaggcucagaucgaggcaaccaaaaagcuacaacaggaaaugaugaaagucaagcaggccaugcuccuggagggcgguuucucugaaacagaugcugccaggggagcgauuaaugcacccaugacuaagguucuugacuggucggggacgcgguacugggccccugaugcucgcgccaccacauauaacgcaggccgauuuucaacuccacagccgagcggcacccugcccgggcguaucaauccuagaacaccaacccccgcuaggggaaguccuuccacuucuagcaacgccuccacagcgaccucaauuuacaguaaucaaacggugagcacucgguuggguucuaccgccggcuccgggacaaacguaucaagccucccaaguacugcacgcaccagaucuuggguggaggaccagaauaggaaccugucccccuucaugcggggagcucauaauaucagcuuugucacaccuccaucgucucgcuccucaagucagggcaccgugagcacgguuccgaaagaggugcuggauuccuggacuggugccuucaacacacgaagacaaccccucuuugcucacauaaggcggcguggggaaucucgcgucuga

SEQ ID NO: 21911 - RNA, 807 nt, Artificial Sequence
  derived and/or modified sequence opt3 from capsid_protein_VP2__Norovirus__AGE89473
auggccggcgcuuucuuugcagggcuggccagcgacgugcucggauccggucuuggcucucugaucaacgcgggggcuggagccauuaaucagaagauagauuucgagaacaauagaaaauugcaacaggcaucauuucaguucaguagcaacuuacagcaagccuccuuucagcacgacaaggaaaugcugcaggcucagaucgaggcaaccaaaaagcuacaacaggaaaugaugaaagucaagcaggccaugcuccuggagggcgguuucucugaaacagaugcugccaggggagcgauuaaugcacccaugacuaagguucuugacuggucggggacgcgguacugggccccugaugcucgcaccacaacuuauaacgccggccgauuuucaaccccacagccgagcggcgcacugcccgggcguaucaauccuagaacaccaacccccgcuaggggaaguuccucuacuagcuccaacgccucaauugcgacaaguauccauagcaaucaaaccgugucuacgcgguuggguuccacugccggcucagggaccaacguaagcagucucccuucuacagcacgcacuagauccuggguggaggaccagaauaggaaccugagcccauucaugcggggagcucacaauauaucguuugucacacccccuucuucccgcucaaguagccagggcaccguguccaccguuccaaaagaggugcuggauucuuggacgggugccuucaacacucgaagacaaccgcucuuugcucauaucaggcggcguggggaaagccgcgucuga

SEQ ID NO: 21912 - RNA, 807 nt, Artificial Sequence
  derived and/or modified sequence opt3 from capsid_protein_VP2__Norovirus__AGE89476
auggccggcgcuuucuuugcagggcuggccagcgacgugcucggauccggucuuggcucucugaucaacgcgggggcuggagccauuaaucagaagauagauuucgagaacaauagaaaauugcaacaggcaucauuucaguucaguagcaacuuacagcaagccuccuuucagcacgacaaggaaaugcugcaggcucagaucgaggcaaccaaaaagcuacaacaggaaaugaugaaagucaagcaggccaugcuccuggagggcgguuucucugaaacagaugcugccaggggagcgauuaaugcaccgaugacuaagguucuugacuggucggggacgcgguacugggccccugaugcucgcaccacaacuuauaacgccggccgauuuucaaccccacagccgagcggcacacugcccgggcguaucaauccuagaaccccaacucccgcaaggggaaguuccucuaccagcuucaacgcuuccaccgccacgucaauucauaguaaucaaacugugagcacccgguuggguucuacagcgggcuccgggacuaacguaucaagccucccuaguaccgcccgcacaagaucuuggguggaggaccagaauaggaaccuguccccauuuaugcggggagcacacaauaucagcuucgucacacccccuucgucucgcuccucaagucagggcacggugagcacuguuccaaaagaggugcuggauuccuggacaggugcuuuuaacacccgaagacaaccccucuucgcccauauaaggcggcguggggaaucucgcgucuga

SEQ ID NO: 21913 - RNA, 807 nt, Artificial Sequence
  derived and/or modified sequence opt3 from capsid_protein_VP2__Norovirus__AGE89479
auggccggcgcuuucuuugcagggcuggccagcgacgugcucggauccggucuuggcucucugaucaacgcgggggcuggagccauuaaucagaagauagauuucgagaacaauagaaaauugcaacaggcaucauuucaguucaguagcaacuuacagcaagccuccuuucagcacgacaaggaaaugcugcaggcucagaucgaggcaaccaaaaagcuacaacaggaaaugaugaaagucaagcaggccaugcuccuggagggcgguuucucugaaacagaugcugccaggggagcgauuaaugcacccaugacuaagguucuugacuggucggggacgcgguacugggccccugaugcucgcaccacaacuuauaacgccggccgauuuucaaccccacagagcaguggcacacugccggggcguaucaaucccagaaccccuacuccagcaaggggauccucuagcacauccucaaacgcuaguaccgccacgagcauucauucuaaucaaacuguguccacccgguuggguucaacagcgggcagcgggacuaacguaaguucucaccccuccaccgcccgcacaagaagcuggguggaggaccagaauaggaaccucucgccuuucaugcggggagcacauaauaucucuuuugucaccccacccuccucacgcaguagcucccagggcacggugucuacuguuccuaaagaggugcuggauagcuggacaggugcuuucaacacccgaagacaaccacuguuugcccacauaaggcggcguggggaaucacgcgucuga

SEQ ID NO: 21914 - RNA, 807 nt, Artificial Sequence; identical to SEQ ID NO: 21850
  derived and/or modified sequence opt3 from capsid_protein_VP2__Norovirus__AGE89482

SEQ ID NO: 21915 - RNA, 807 nt, Artificial Sequence
  derived and/or modified sequence opt3 from capsid_protein_VP2__Norovirus__AGE89485
auggccggcgcuuucuuugcagggcuggccagcgacgugcucggauccggucuuggcucucugaucaacgcgggggcuggagccauuaaucagaagauagauuucgagaacaauagaaaauugcaacaggcaucauuucaguucaguagcaacuuacagcaagccuccuuucagcacgacaaggaaaugcugcaggcucagaucgaggcaaccaaaaagcuacaacaggaaaugaugaaagucaagcaggccaugcuccuggagggcgguuucucugaaacagaugcugccaggggagcgauuaaugcacccaugacuaagguucuugacuggucggggacgcgguacugggccccugaugcucgcaccacaacuuauaacgccggccgauuuucaaccccacagccgagcggcacacugcccgggcguaucaauccuagaaccccaacucccgcaaggggaaguuccucuacaagcuccaacgcuucaaccgccacgaguauucauagcaaucaaacugugucuacccgguuggguuccacagcgggcucagggacuaacguaagcagucucccuucuaccgcccgcacaagauccuggguggaggaccagaauaggaaccugagcccauucaugcggggagcacgcaauaucucguuugucacgcccccuucuucccgaucaaguagccagggcaccguguccacuguuccaaaagaggugcuggauucuuggacaggugcuuucaacaccagaaggcaaccgcucuuugcccacauacggcgucgcggggaaagcagagucuga

SEQ ID NO: 21916 - RNA, 807 nt, Artificial Sequence
  derived and/or modified sequence opt3 from capsid_protein_VP2__Norovirus__AGE89488
auggccggcgcuuucuuugcagggcuggccagcgacgugcucggauccggucuuggcucucugaucaacgcgggggcuggagccauuaaucagaagauagauuucgagaacaauagaaaauugcaacaggcaucauuucaguucaguagcaacuuacagcaagccuccuuucagcacgacaaggaaaugcugcaggcucagaucgaggcaaccaaaaagcuacaacaggaaaugaugaaagucaagcaggccaugcuccuggagggcgguuucucugaaacagaugcugccaggggagcgauuaaugcacccaugacuaagguucuugacuggucggggacgcgguacugggccccugaugcucgcaccacaacuuauaacgccggccgauuuucagcaccacagccgagcggcagucugcccgggcguaucaauccuagagcuccaacccccgccaggguguccucuagcacauccucaaacgcgaguaccguaacuagcauuuacucuaaucaaacaguguccacccgguugggaucaacggccgguagcggcacuaacgucaguucucucccuuccaccgcacgcacaagaagcuggguggaggaccagaauaggaaccugucgccauucaugcgcggggcucauaauaucucuuuuguuacucccccuuccucacggaguagcucccagggaaccgugucuacagucccaaaagaggugcuggauagcuggaccggcgccuucaacacgcgaagacaaccgcucuuugcucacauaaggcggcguggugaaucacgcguauga

SEQ ID NO: 21917 - RNA, 807 nt, Artificial Sequence; identical to SEQ ID NO: 21842
  derived and/or modified sequence opt3 from capsid_protein_VP2__Norovirus__AGE89491

SEQ ID NO: 21918 - RNA, 807 nt, Artificial Sequence
  derived and/or modified sequence opt3 from capsid_protein_VP2__Norovirus__AGE89494
auggccggcgcuuucuuugcagggcuggccagcgacgugcucggauccggucuuggcucucugaucaacgcgggggcuggagccauuaaucagaagauagauuucgagaacaauagaaaauugcaacaggcaucauuucaguucaguagcaacuuacagcaagccuccuuucagcacgacaaggaaaugcugcaggcucagaucgaggcaaccaaaaagcuacaacaggaaaugaugaaagucaagcaggccaugcuccuggagggcgguuucucugaaacagaugcugccaggggagcgauuaaugcacccaugacuaagguucuugacuggucggggacgcgguacugggccccugaugcucgcaccaucacauauaacgccggccgauuuucaacuccacagccgagcggcacccugcccgggcguauuaauccuagagcaccaacacccgcuaggggaaguuccucuaccagcuccaacgccucaacugcgacaaguaucuacagcaaucaaaccgugucuacgcgguuggguuccacugccggcucagggaccaacguaagcagucucccuucuacagcacgcacuagauccuggguggaggaccagaauaggaaccugagcccauucaugcggggagcucauaauauaucguuugucacacccccuucuucccgcucaaguagccagggcaccguguccaccguuccaaaagaggugcuggauucuuggacgggugccuucaacacucgaagacaaccgcucuuugcucacaucaggcggcguggggaaagccgcgucuga

SEQ ID NO: 21919 - RNA, 807 nt, Artificial Sequence
  derived and/or modified sequence opt3 from capsid_protein_VP2__Norovirus__AGE89497
auggccggcgcuuucuuugcagggcuggccagcgacgugcucggauccggucuuggcucucugaucucagcgggggcuggagccauuaaccagaagauagauuucgagaauaacagaaaauugcaacaggcaaguuuucaguucagcuccaauuuacagcaagccucuuuucagcacgacaaggaaaugcugcaggcucagaucgaggcaaccaaaaagcuacaacaggaaaugaugaaagucaagcaggccaugcuccuggagggcgguuucucggaaacagaugcugccaggggagcgauuaacgcacccaugacuaagguucuugacuggucagggacgcgguacugggccccugaugcucgcaccacaacuuauaaugccggccgauuuagcaccccacagccgaguggcacacugcccgggcguaucaacccuagaaccccaacucccgcaaggggauccucuagcacauccucaaaugcuaguaccgccacgagcauuuacucuaaccaaacuguguccacccgguuggguucaacagcgggcagcgggacuaauguaaguucucucccuuccaccgcccgcacaagaagcuggguggaggaccagaacaggaaucugucgccauucaugcggggagcacauaacaucucuuuugucacgcccccuuccucacgcaguagcucccagggcaccgugucuacuguuccaaaagaggugcuggauagcuggacaggugcuuucaauacccgaagacaaccgcucuuugcccacauaaggcggcguggggaaucacgcgucuga

SEQ ID NO: 21920 - RNA, 807 nt, Artificial Sequence; identical to SEQ ID NO: 21842
  derived and/or modified sequence opt3 from capsid_protein_VP2__Norovirus__AGE89500

SEQ ID NO: 21921 - RNA, 807 nt, Artificial Sequence; identical to SEQ ID NO: 21842
  derived and/or modified sequence opt3 from capsid_protein_VP2__Norovirus__AGE89503

SEQ ID NO: 21922 - RNA, 807 nt, Artificial Sequence
  derived and/or modified sequence opt3 from capsid_protein_VP2__Norovirus__AGE89506
auggccggcgcuuucuuugcagggcuggccagcgacgugcucggauccggucuuggcucucugaucaacgcgggggcuggagccauuaaucagaagauagauuucgagaacaauagaaaauugcaacaggcaucauuucaguucaguagcaacuuacagcaagccuccuuucagcacgacaaggaaaugcugcaggcucagaucgaggcaaccaaaaagcuacaacaggaaaugaugaaagucaagcaggccaugcuccuggagggcgguuucucugaaacagaugcugccaggggagcgauuaaugcacccaugacuaagguucuugacuggucggggacgcgguacugggccccugaugcucgcaccacaacuuauaacgccggccgauuuucaaccccacagccgagcggcacacugcccgggcguaucaauccuagaaccccaacucccgcaaggggaaguuccucuacaagcuccaacgcuucaaccgccacgaguaugcauagcaaucaaacugugucuacccgguuggguuccacagcgggcucagggacuaacguaagcagucucccuucuaccgcccgcacaagauccuggguggaggaccagaauaggaaccugagcccauucaugcggggagcacacaauauuucguuugucacgcccccuucuucccgcucaaguagccagggcaccguguccacuguuccaaaagaggugcuggauucuuggacaggugcuuucaacacccgaagacaaccgcucuuugcccauaucaggcggcguggggaaagccgcgucuga

SEQ ID NO: 21923 - RNA, 807 nt, Artificial Sequence
  derived and/or modified sequence opt3 from capsid_protein_VP2__Norovirus__AGE89509
auggccggcgcuuucuuugcagggcuggccagcgacgugcucggauccggucuuggcucucugaucaacgcgggggcuggagccauuaaucagaagauagauuucgagaacaauagaaaauugcaacaggcaucauuucaguucaguagcaacuuacagcaagccuccuuucagcacgacaaggaaaugcugcaggcucagaucgaggcaaccaaaaagcuacaacaggaaaugaugaaagucaagcaggccaugcuccuggagggcgguuucucugaaacagaugcugccaggggagcgauuaaugcacccaugacuaagguucuugacuggucggggacgcgguacugggccccugaugcucgcaccacaacuuauaacgccggccgauuuucaaccccacagccgagcggcagucugcccgggcguaucaauccuagagcaccaacacccgcuagggccuccucuagcauuuccucaaacgcgaguaccgugacuagcaucuacucuaaucaaacaguauccacccgguugggaucaacggccgguagcggcacuaacgugaguucucucccuuccaccgcacgcacaagaagcugggucgaggaccagaauaggaaccugucgccauucaugcgcggggcucauaauauaucuuuugugacucccccuuccucacggaguagcucccagggaaccguuucuacagugccaaaagagguccuggauagcuggaccggcgccuucaacacgcgaagacaaccgcucuuugcucacaucaggcggcguggugaaucacgcguguga

SEQ ID NO: 21924 - RNA, 807 nt, Artificial Sequence; identical to SEQ ID NO: 21842
  derived and/or modified sequence opt3 from capsid_protein_VP2__Norovirus__AGE89512

SEQ ID NO: 21925 - RNA, 807 nt, Artificial Sequence; identical to SEQ ID NO: 21850
  derived and/or modified sequence opt3 from capsid_protein_VP2__Norovirus__AGE89515

SEQ ID NO: 21926 - RNA, 807 nt, Artificial Sequence
  derived and/or modified sequence opt3 from capsid_protein_VP2__Norovirus__AGE89518
auggccggcgcuuucuuugcagggcuggccagcgacgugcucggauccggucuuggcucucugaucaacgcgggggcuggagccauuaaucagaagauagauuucgagaacaauagaaaauugcaacaggcaucauuucaguucaguagcaacuuacagcaagccuccuuucagcacgacaaggaaaugcugcaggcucagaucgaggcaaccaaaaagcuacaacaggaaaugaugaaagucaagcagacaaugcuccuggagggcgguuucucugaaacugaugccgcuaggggagccauuaaugcgcccaugacgaagguucuugacuggucggggacccgguacugggcaccugaugcccgcacaacuaccuauaacgcuggccgauuuucaacaccacagccgagcggcacccugcccgggcguaucaauccuagaacuccaacacccgccaggggaaguuccucuaccagcuccaacgcaucaacggcuaccaguauucauagcaaucaaacugugucuacacgguuggguuccacugccggcucagggaccaacguaagcagucucccuucuacagcgcgcaccagauccuggguggaggaccagaauaggaaccugagcccauucaugcggggagcccacaauaucucguuugucacgcccccuucuucccgcucaaguagccagggcacuguguccacaguuccaaaagaggugcuggauucuuggaccggugcauucaacacucgaagacaaccgcucuuugcucauauaaggcggcguggggaaagccgcgucuga

SEQ ID NO: 21927 - RNA, 807 nt, Artificial Sequence
  derived and/or modified sequence opt3 from capsid_protein_VP2__Norovirus__AGE89521
auggccggcgcuuucuuugcagggcuggccagcgacgugcucggauccggucuuggcucucugaucaacgcgggggcuggagccauuaaucagaagauagauuucgagaacaauagaaaauugcaacaggucucauuucaguucaguagcaacuuacagcaagcauccuuucagcacgacaaggaaaugcugcaggcccagaucgaggcuaccaaaaagcuacaacaggaaaugaugaaaguuaagcaggcaaugcuccuggagggcgguuucucugaaacagaugccgcuaggggagccauuaaugcgcccaugacuaaggugcuugacuggucggggacgcgguacugggcaccugaugcccgcaccacaacuuauaacgcuggccgauuuucaaccccacagccgagcggcacacugcccgggcguaucaauccuagaaccccaacucccgccaggggaaguuccucuacaagcuccaacgcaucaaccgcuacgaguauucauagcaaucaaacuguaucuacccgguuggguuccacagccggcucagggacuaacgugagcagucucccuucuaccgcgcgcacaagauccugggucgaggaccagaauaggaaccugagcccauucaugcggggagcccacaauaucucguuugugacgcccccuucuucccgcucaaguagccagggcaccguuuccacugugccaaaagagguccuggauucuuggacaggugcauucaacacccgaagacaaccgcucuuugcucauauaaggcggcguggggaaagccgcguguga

SEQ ID NO: 21928 - RNA, 807 nt, Artificial Sequence; identical to SEQ ID NO: 21842
  derived and/or modified sequence opt3 from capsid_protein_VP2__Norovirus__AGE89524

SEQ ID NO: 21929 - RNA, 807 nt, Artificial Sequence
  derived and/or modified sequence opt3 from capsid_protein_VP2__Norovirus__AGE89530
auggccggcgcuuucuuugcagggcuggccagcgacgugcucggauccggucuuggcucucugaucaacgcgggggcuggagccauuaaucagaagauagauuucgagaacaauagaaaauugcaacaggcaucauuucaguucaguagcaacuuacagcaagccuccuuucagcacgacaaggaaaugcugcaggcucagaucgaggcaaccaaaaagcuacaacaggaaaugaugaaagucaagcaggccaugcuccuggagggcgguuucucugaaacagaugcugccaggggagcgauuaaugcacccaugacuaagguucuugacuggucggggacgcgguacugggccccugaugcucgcaccacaacuuauaacgccggccgauuuucaaccccacagccgagcggcacacugcccgggcguaccaauccuagaacuccaacacccgcaaggggaaguuccucuaccagcuccaacgcuucaacggccaccaguaucuacagcaaucaaacugugucuacacgguuggguuccacugcgggcucagggaccaacguaagcagucucccuucuacagcccgcaccagauccuggguggaggaccagaauaggaaccugagcccauucaugcggggagcacauaauauuucguuugucacgcccccuucuucccgcucaaguagccagggcacuguguccacaguuccaaaagaggugcuggauucuuggaccggugcuuucaacacucgaagacaaccgcucuuugcccacaucaggcggcguggggaaagccgcgucuga

SEQ ID NO: 21930 - RNA, 807 nt, Artificial Sequence
  derived and/or modified sequence opt3 from capsid_protein_VP2__Norovirus__AGE89533
auggccggcgcuuucuuugcagggcuggccagcgacgugcucggauccggucuuggcucucugaucaacgcgggggcuggagccauuaaucagaagauagauuucgagaacaauagaaaauugcaacaggcaucauuucaguucaguagcaacuuacagcaagccuccuuucagcacgacaaggaaaugcugcaggcucagaucgaggcaaccaaaaagcuacaacaggaaauuaugaaagucaagcaggccaugcuccuggagggcgguuucucugaaacagaugcugccaggggagcgaucaaugcacccaugacuaagguucuugacuggucggggacgcgguacugggccccugaugcucgcaccacaacuuauucagccggccgauuuagcaccccacagccgaguggcacacugcccgggcguauuaacccuagaaccccaacucccgcaaggggauccucuagcacauucuccaaugcuucaaccgccacgaguauccauagcaaccaaacugugucuacccgguuggguuccacagcgggcucagggacuaauguaagcagucucccuucuaccgcccgcacaagauccuggguggaggaccagaacaggaaucugagcccauuuaugcggggagcacacaacauaucguucgucaccccgccuucuucccgcucaaguagccagggcacgguguccacuguuccaaaagaggugcuggauucuuggacaggugcuuuuaauacccgaagacaaccccucuucgcccauaucaggcggcguggggaaagccgcgucuga

SEQ ID NO: 21931 - RNA, 807 nt, Artificial Sequence; identical to SEQ ID NO: 21850
  derived and/or modified sequence opt3 from capsid_protein_VP2__Norovirus__AGE89536

SEQ ID NO: 21932 - RNA, 807 nt, Artificial Sequence; identical to SEQ ID NO: 21850
  derived and/or modified sequence opt3 from capsid_protein_VP2__Norovirus__AGE89539

SEQ ID NO: 21933 - RNA, 807 nt, Artificial Sequence; identical to SEQ ID NO: 21850
  derived and/or modified sequence opt3 from capsid_protein_VP2__Norovirus__AGE89542

SEQ ID NO: 21934 - RNA, 807 nt, Artificial Sequence; identical to SEQ ID NO: 21850
  derived and/or modified sequence opt3 from capsid_protein_VP2__Norovirus__AGE89545

SEQ ID NO: 21935 - RNA, 807 nt, Artificial Sequence
  derived and/or modified sequence opt3 from capsid_protein_VP2__Norovirus__AGE89548
auggccggcgcuuucuuugcagggcuggccagcgacgugcucggauccggucuuggcucucugaucaacgcgggggcuggagccauuaaucagaagauagauuucgagaacaauagaaaauugcaacaggcaucauuucaguucaguagcaacuuacagcaagccuccuuucagcacgacaaggaaaugcugcaggcucagaucgaggcaaccaaaaagcuacaacaggaaaugaugaaagucaagcaggccaugcuccuggagggcgguuucucugaaacagaugcugccaggggagcgauuaaugcacccaugacuaagguucuugacuggucggggacgcgguacugggccccugaugcucgcaucaccacauauaacgccggccgauuuucaacuccacagccgagcggcacccugcccgggcguauuaauccuagaacaccaacccccgcaaggggaaguuccucuacuagcuccaacgcuucaacagccaccaguauccauagcaaucaaacggugucuacucgguuggguuccaccgcgggcucagggacaaacguaagcagucucccuucuacugcccgcaccagauccuggguggaggaccagaauaggaaccugagcccauucaugcggggagcacacaauauaucguuugucacacccccuucuucccgcucaaguagccagggcaccguguccacgguuccaaaagaggugcuggauucuuggacuggugcuuucaacacacgaagacaaccgcucuuugcccauaucaggcggcguggggaaagccgcgucuga

SEQ ID NO: 21936 - RNA, 807 nt, Artificial Sequence; identical to SEQ ID NO: 21842
  derived and/or modified sequence opt3 from capsid_protein_VP2__Norovirus__AGE89551

SEQ ID NO: 21937 - RNA, 807 nt, Artificial Sequence
  derived and/or modified sequence opt3 from capsid_protein_VP2__Norovirus__AGE89554
auggccggcgcuuucuuugcagggcuggccagcgacgugcucggauccggucuuggcucucugaucaacgcgggggcuggagccauuaaucagaagauagauuucgagaacaauagaaaauugcaacaggcaucauuucaguucaguagcaacuuacagcaagccuccuuucagcacgacaaggaaaugcugcaggcucagaucgaggcaaccaaaaagcuacaacaggaaaugaugaaagucaagcaggccaugcuccuggagggcgguuucucugaaacagaugcugccaggggagcgauuaaugcacccaugacuaagguucuugacuggucggggacgcgguacugggccccugaugcucgcaccacaacuuauaacgccggccgauuuucagcaccacagccgagcggcagucugcccgggcguaucaauccuagagcuccaacccccgccaggguguccucuagcacauccucaaacgcgaguaccguaacuagcauuuacucuaaucaaacaguguccacccgguugggaucaacggccgguagcggcacuaacgucaguucucucccuuccaccgcacgcacaagaagcuggguggaggaccagaauaggaaccugucgccauucaugcgcggggcucauaauaucucuuuuguuacucccccuuccucacggaguagcucccagggaaccgugucuacagucccaaaagaggugcuggauagcuggaccggcgccuucaacacgcgaagacaaccgcucuuugcucacguaaggcggcguggugaaucacgcguuuga

SEQ ID NO: 21938 - RNA, 807 nt, Artificial Sequence; identical to SEQ ID NO: 21850
  derived and/or modified sequence opt3 from capsid_protein_VP2__Norovirus__AGE89557

SEQ ID NO: 21939 - RNA, 807 nt, Artificial Sequence
  derived and/or modified sequence opt3 from capsid_protein_VP2__Norovirus__AGE89560
auggccggcgcuuucuuugcagggcuggccagcgacgugcucggauccggucuuggcucucugaucaacgcgggggcuggagccauuaaucagaagauagauuucgagaacaauagaaaauugcaacaggcaucauuucaguucaguagcaacuuacagcaagccuccuuucagcacgacaaggaaaugcugcaggcucagaucgaggcaaccaaaaagcuacaacaggaaaugaugaaagucaagcaggccaugcuccuggagggcgguuucucugaaacagaugcugccaggggagcgauuaaugcacccaugacuaagguucuugacuggucggggacgcgguacugggccccugaugcucgcaccacaacuuauaacgccggccgauuuucaaccccacagccgagcggcacacugcccgggcguaucaauaguagaaccccuacuccagcaaggggauccucuagcacauccucaaacgcuaguaccgccacgagcauuuacucuaaucaaacuguguccacccgguuggguucaacagcgggcagcgggacuaacguaaguucucuccccuccaccgcccgcacaagaagcuggguggaggaccagaauaggaaccugucgccuuucaugcggggagcacauaauaucucuuuugucaccccacccuccucacgcaguagcucccagggcacggugucuacuguuccuaaagaggugcuggauagcuggacaggugcuuucaacacccgaagacaaccacucuuugcccacauaaggcggcguggggaaucacgcgucuga

SEQ ID NO: 21940 - RNA, 807 nt, Artificial Sequence
  derived and/or modified sequence opt3 from capsid_protein_VP2__Norovirus__AGE89563
auggccggcgcuuucuuugcagggcuggccagcgacgugcucggauccggucuuggcucucugaucaacgcgggggcuggagccauuaaucagaagauagauuucgagaacaauagaaaauugcaacaggcaucauuucaguucaguagcaacuuacagcaagccuccuuucagcacgacaaggaaaugcugcaggcucagaucgaggcaaccaaaaagcuacaacaggaaaugaugaaagucaagcaggccaugcuccuggagggcgguuucucugaaacagaugcugccaggggagcgauuaaugcacccaugacuaagguucuugacuggucggggacgcgguacugggccccugaugcucgcaccacaacuuauaacgccggccgauuuucaaccccacagccgagcggcaugcugcccgggcguaucaauccuagaacaccaacccccgcaaggggaaguuccucuacuagcuccaacgcuucaacagccaccaguauucauagcaaucaaacggugucuacucgguuggguuccaccgcgggcucagggacaaacguaagcagucucccuucuacugcccgcaccagauccuggguggaggaccagaauaggaaccugagcccauucaugcggggagcacacaauaucucguuugucacacccccuucuucccgcucaaguagccagggcaccguguccacgguuccaaaagaggugcuggauucuuggacuggugcuuucaacacacgaagacaaccgcucuuugcccauauaaggcggcguggggaaagccgcgucuga

SEQ ID NO: 21941 - RNA, 807 nt, Artificial Sequence
  derived and/or modified sequence opt3 from capsid_protein_VP2__Norovirus__AGE89566
auggccggcgcuuucuuugcagggcuggccagcgacgugcucuccucuggacuugguucacugaucaacgcgggcgcuggggccauuaaucagaagauagauuucgagaacaauagaaaauugcaacaggcaaguuuucaguucagcuccaacuuacagcaagccucuuuucagcacgacaaggaaaugcugcaggcucagaucgaggcaaccaaaaagcuacaacaggaaaugaugaaagucaagcaggccaugcuccuggagggaggcuucucggaaacagaugcugccaggggugcgauuaaugcacccaugacuaagguucuugacuggucagggacgcgguacugggccccugaugcucgcaccacaacuuauaacgccggacgauuuagcaccccacagccgaguggcacacugcccggccguaucaauccucggauuccaacccccgcaaggggguccucuagcacuuccucaaacgcuaguacagccaccagcaucuacucuaaucaaacgguguccacucgguugggaucaaccgcggguagcggcacaaacguaaguucucucccuuccacugcccgcaccagaagcuggguggaggaccagaauaggaaccugucgccauucaugagaggggcacauaauauaucuuuugucacacccccuuccucacgcaguagcucccagggaaccgugucuacgguuccaaaagaggugcuggauagcuggacuggcgcuuucaacacacgaagacaaccgcucuuugcccacaucaggcggcguggugaaucacgcgucuga

SEQ ID NO: 21942 - RNA, 807 nt, Artificial Sequence; identical to SEQ ID NO: 21850
  derived and/or modified sequence opt3 from capsid_protein_VP2__Norovirus__AGE89569

SEQ ID NO: 21943 - RNA, 807 nt, Artificial Sequence; identical to SEQ ID NO: 21850
  derived and/or modified sequence opt3 from capsid_protein_VP2__Norovirus__AGE89572

SEQ ID NO: 21944 - RNA, 807 nt, Artificial Sequence
  derived and/or modified sequence opt3 from capsid_protein_VP2__Norovirus__AGE89578
auggccggcgcuuucuuugcagggcuggccagcgacgugcucggauccggucuuggcucucugaucaacgcgggggcuggagccauuaaucagaagauagauuucgagaacaauagaaaauugcaacaggcaucauuucaguucaguagcaacuuacagcaagccuccuuucagcacgacaaggaaaugcugcaggcucagaucgaggcaaccaaaaagcuacaacaggaaaugaugaaagucaagcaggccaugcuccuggagggcgguuucucugaaacagaugcugccaggggagcgauuaaugcacccaugacuaagguucuugacuggucggggacgcgguacugggccccugaugcucgcaccacaacuuauaacgccggccgauuuucaaccccacagccgagcggcacacuguuggagcgugugaaucccagaaccccuacuccagcaagggggaguuccucuacaagcuccaacgcuucaaccgccacgaguauccauagcaaucaaacuguaucuacccggcucggauccacagcggguucaggcacuaacgugagcagucugcccucuaccgcccgcacaagauccugggucgaggaccagaauaggaaccugagcccuuucaugcgcggggcacacaauauuucguuugugaccccacccucuucccggucaaguagccagggaacgguuuccacugugccuaaagaaguccucgauucuuggacaggcgcuuucaacacccgaagacaaccauuauuugcccauaucaggcggcguggugagagccgcguguga

SEQ ID NO: 21945 - RNA, 807 nt, Artificial Sequence
  derived and/or modified sequence opt3 from capsid_protein_VP2__Norovirus__AGE89581
auggccggcgcuuucuuugcagggcuggccagcgacgugcucggauccggucuuggcucucugaucaacgcgggggcuggagccauuaaucagaagauagauuucgagaacaauagaaaauugcaacaggcaucauuucaguucaguagcaacuuacagcaagccuccuuucagcacgacaaggaaaugcugcaggcucagaucgaggcaaccaaaaagcuacaacaggaagucaugaaaguuaagcaggccaugcuccuggagggcgguuucucugaaacagaugcugccaggggagcgauuaaugcacccaugacuaaggugcuugacuggucggggacgcgguacugggccccugaugcucgcaccacaacuuauaacgccggccgauuuucaaccccacagccgagcggcacacugcccgggcguaucaauccuagaaccccaacucccgcaaggggaaguuccucuacaagcuccaacgcuucaaccgccacgaguauuuacagcaaucaaacuguaucuacccgguuggguuccacagcgggcucagggacuaacgugagcagucucccuucuaccgcccgcacaagauccugggucgaggaccagaauaggaaccugagcccauucaugcggggagcacauaauaucucguuugugacgcccccuucuucccgcucaaguagccagggcaccguuuccacugugccaaaagagguccuggauucuuggacaggugcuuucaacacccgaagacaaccgcucuuugcccacauaaggcggcguggggaaagccgcguguga

SEQ ID NO: 21946 - RNA, 807 nt, Artificial Sequence; identical to SEQ ID NO: 21940
  derived and/or modified sequence opt3 from capsid_protein_VP2__Norovirus__AGE89587

SEQ ID NO: 21947 - RNA, 807 nt, Artificial Sequence
  derived and/or modified sequence opt3 from capsid_protein_VP2__Norovirus__AGE89590
auggccggcgcuuucuuugcagggcuggccagcgacgugcucggauccggucuuggcucucugaucaacgcgggggcuggagccauuaaucagaagauagauuucgagaacaauagaaaauugcaacaggcaucauuucaguucaguagcaacuuacagcaagccuccuuucagcacgacaaggaaaugcugcaggcucagaucgaggcaaccaaaaagcuacaacaggaaaugaugaaagucaagcaggccaugcuccuggagggcgguuucucugaaacagaugcugccaggggagcgauuaaugcacccaugacuaagguucuugacuggucggggacgcgguacugggccccugaugcucgcaccacaacuuauaacgccggccgauuuucaaccccacagccgagcggcacacugcccgagcgugugaauccuagaaccccaacucccgcaagggggaguuccucuacaagcuccaacgcuucaaccgccacgaguauccauagcaaucaaacuguaucuacccgguugggauccacagcggguucaggcacuaacgugagcagucucccuucuaccgcccgcacaagauccugggucgaggaccagaauaggaaccugagcccauucaugcgcggggcacacaauauuucguuugugacgcccccuucuucccggucaaguagccagggaaccguuuccacugugccaaaagaaguccuggauucuuggacaggcgcuuucaacacccgaagacaaccgcucuuugcccauaucaggcggcguggugagagccgcguguga

SEQ ID NO: 21948 - RNA, 807 nt, Artificial Sequence; identical to SEQ ID NO: 21842
  derived and/or modified sequence opt3 from capsid_protein_VP2__Norovirus__AGE89593

SEQ ID NO: 21949 - RNA, 807 nt, Artificial Sequence
  derived and/or modified sequence opt3 from capsid_protein_VP2__Norovirus__AGE89596
auggccggcgcuuucuuugcagggcuggccagcgacgugcucggauccggucuuggcucucugaucaacgcgggggcuggagccauuaaucagaaggucgaguucgaaaacaauagaaaauugcaacaggcaucauuucaguucaguagcaacuuacagcaagccuccuuucagcacgauaaggagaugcugcaggcucagauagaagcaaccaaaaagcuacaacaggagaugaugaggguuaaacaggccaugcuccuggaaggcgguuucucugagacagacgcugcccgcggggcgaucaaugcacccaugacuaagacgcuugauuggucgggaacccgguacugggccccugacgcucgaacaacuaccuauaacgccggccguuuuucaacaccacagccgagcggcgcacugcccgggagagcuaauuugagggccaccgugccugcgcggggaaguuccucuacuagcuccaacucaaguauugccacaagcguauacucuaaucaaaccacguccacucgccucgguucaaccgcaggcagcgggacaagugugucuucccugccaagcacugcuagaaccaggucgugggucgaggaucagaaccggaaucugucucccuucaugcgcggagcccauaacaucuccuuugugacaccuccaucaagucgaagcuccucucagggcaccguuagcacggugcccaaggaaguccucgacucauggacuggugcuuucaauacaagaaggcaaccuuuauuugcccacauucggaaacguggggagagucgcguguga

SEQ ID NO: 21950 - RNA, 807 nt, Artificial Sequence
  derived and/or modified sequence opt3 from capsid_protein_VP2__Norovirus__AGE89599
auggccggcgcuuucuuugcagggcuggccagcgacgugcucggauccggucuuggcucucugaucaacgcgggggcuggagccauuaaucagaagauagauuucgagaacaauagaaaauugcaacaggcaucauuucaguucaguagcaacuuacagcaagccuccuuucagcacgacaaggaaaugcugcaggcucagaucgaggcaaccaaaaagcuacaacaggaaaugaugaaagucaagcaggccaugcuccuggagggcgguuucucugaaacagaugcugccaggggagcgauuaaugcacccaugacuaagguucuugacuggucggggacgcgguacugggccccugaugcucgcaccacaacuuauaacgccggccgauuuucaaccccacagccgagcggcacacugcccgggcguaccaauccuagaacuccaacacccgcaaggggaaguuccucuaucagcuccaacgcuucaaccgccacgaguauucauagcaaucaaacugugucuacccgguuggguuccacagcgggcucagggacuaacguaagcagucucccuucuaccgcccgcacaagauccuggguggaggaccagaauaggaaccugagcccauucaugcggggagcacacaauaucucguuugucacgcccccuucuucccgcucaaguagccagggcaccguguccacuguuccaaaagaggugcuggauucuuggacaggugcuuucaacacccgaagacaaccgcucuuugcccauauaaggcggcguggggaaagccgcgucuga

SEQ ID NO: 21951 - RNA, 807 nt, Artificial Sequence
  derived and/or modified sequence opt3 from capsid_protein_VP2__Norovirus__AGE89602
auggccggcgcuuucuuugcagggcuggccagcgacgugcucggauccggucuuggcucucugaucaacgcgggggcuggagccauuaaucagaagauagauuucgagaacaauagaaaauugcaacaggcaucauuucaguucaguagcaacuuacagcaagccuccuuucagcacgacaaggaaaugcugcaggcucagaucgaggcaaccaaaaagcuacaacaggaaaugaugaaagucaagcaggccaugcuccuggagggcgguuucucugaaacagaugcugccaggggagcgauuaaugcacccaugacuaagguucuugacuggucggggacgcgguacugggccccugaugcucgcaccacaacuuauaacgccggccgauuuucaaccccacagccgagcggcacacugcccgggcguaucaauccuagaaccccaacucccgcaaggggaaguuccucuacaagcuccaacgcuucaaccgccacgaguauucauagcaaucaaacugcgucuacccgguuggguuccacagccggcucagggacuaacgugagcagucucccuucuaccgcacgcacaagauccuggguagaggaccagaauaggaaccugagcccauucaugcggggagcucacaauaucucguuugugacgcccccuucuucccgcucaaguagccagggcaccgucuccacugugccaaaagagguucuggauucuuggacaggugccuucaacacccgaagacaaccgcucuuugcucauauaaggcggcguggggaaagccgcguguga

SEQ ID NO: 21952 - RNA, 807 nt, Artificial Sequence
  derived and/or modified sequence opt3 from capsid_protein_VP2__Norovirus__AGE89605
auggccggcgcuuucuuugcagggcuggccagcgacgugcucggauccggucuuggcucucugaucaacgcgggggcuggagccauuaaucagaagauagauuucgagaacaauagaaaauugcaacaggcaucauuucaguucaguagcaacuuacagcaagccuccuuucagcacgacaaggaaaugcugcaggcucagaucgaggcaaccaaaaagcuacaacaggaaaugaugaaagucaagcaggccaugcuccuggagggcgguuucucugaaacagaugcugccaggggagcgauuaaugcacccaugacuaagguucuugacuggucggggacgcgguacugggccccugaugcucgcaccacaacuuauaacgccggccgauuuucaaccccacagccgagcggcacacugcccgggcguaucaauccuagaaccccaacucccgcaaggggaaguuccucuacaagcuccaacgcuucaaccgccacgaguauucauagcaaucaaacugugucuacccgguuggguuccacagcgggcucagggacuaacguaagcagucucccuucuaccgcccgcacaagauccuggguggaggaccagaauaggagccugucgccauucaugcggggagcacacaacaucucuuuugucacgcccccuuccucacgcaguagcucccagggcaccgugucuacuguuccaaaagaggugcuggauagcuggacaggugcuuucaauacccgaagacaaccgcucuuugcccauauaaggcggcguggggaaucacgcgucuga

SEQ ID NO: 21953 - RNA, 807 nt, Artificial Sequence
  derived and/or modified sequence opt3 from capsid_protein_VP2__Norovirus__AGE89608
auggccggcgcuuucuuugcagggcuggccagcgacgugcucggauccggucuuggcucucugaucaacgcgggggcuggagccauuaaucagaagauagauuucgagaacaauagaaaauugcaacaggcaucauuucaguucaguagcaacuuacagcaagccuccuuucagcacgacaaggaaaugcugcaggcucagaucgaggcaaccaaaaagcuacaacaggaaaugaugaaagucaagcaggccaugcuccuggagggcgguuucucugaaacagaugcugccaggggagcgauuaaugcacccaugacuaagguucuugacuggucggggacgcgguacugggccccugaugcucgcaccacaacuuauaacgccggccgauuuucaaccccacagccgagcggcacacugcccgggcguaucaauccuagaaccccaacucccgcaaggggaaguuccucuacaagcuccaacgcuucaaccgccacgaguauucauagcaaucaaacugugucuacccgguuggguuacacagcgggcuccgggacuaacguaucaagccucccuaguaccgcccgcacaagaucuuggguggaggaccagaauaggucccugagcccauucaugcggggagcacacaacaucucguuugucacgcccccuucuucccgcucaaguagccagggcaccguguccacuguuccaaaagaggugcuggauucuuggacaggugcuuucaauacccgaagacaaccgcucuuugcccauauaaggcggcguggggaaagccgcgucuga

SEQ ID NO: 21954 - RNA, 807 nt, Artificial Sequence
  derived and/or modified sequence opt3 from capsid_protein_VP2__Norovirus__AGE89611
auggccggcgcuuucuuugcagggcuggccagcgacgugcucggauccggucuuggcucucugaucaacgcgggggcuggagccauuaaucagaagauagauuucgagaacaauagaaaauugcaacaggcaucauuucaguucaguagcaacuuacagcaagccuccuuucagcacgacaaggaaaugcugcaggcucagaucgaggcaaccaaaaagcuacaacaggaaaugaugaaagucaagcaggccaugcuccuggagggcgguuucucugaaacagaugcugccaggggagcgauuucggcacccaugacuaagguucuugacuggucagggacgcgguacugggccccugaugcucgcaccacaacuuauaaugccggccgauuuagcaccccacagccgaguggcacacugcccgggcguaucaacccuagaaccccaacucccgcaaggggauccucuagcacauccucaaaugcuccuaccgccacgaguauuuacagcaaccaaacugugucuacccgguuggguuccacagcgggcucagggacuaauguaagcagucucccaucuaccgcccgcacaagauccuggguggaggaccagaacaggaaucugagccccuucaugcggggagcacauaacaucucguuugucaccccuccaucuucccgcucaaguagccagggcacgguguccacuguuccgaaagaggugcuggauucuuggacaggugcuuucaauacccgaagacaaccccucuuugcccacauaaggcggcguggggaaagccgcgucuga

SEQ ID NO: 21955 - RNA, 807 nt, Artificial Sequence
  derived and/or modified sequence opt3 from capsid_protein_VP2__Norovirus__AGE89614
auggccggcgcuuucuuugcagggcuggccagcgacgugcucggauccggucuuggcucucugaucaacgcgggggcuggagccauuaaucagaagauagauuucgagaacaauagaaaauugcaacaggcaucauuucaguucaguagcaacuuacagcaagccuccuuucagcacgacaaggaaaugcugcaggcucagaucgaggcaaccaaaaagcuacaacaggaaaugaugaaagucaagcaggccaugcuccuggagggcgguuucucugaaacagaugcugccaggggagcgauuaaugcacccaugacuaagguucuugacuggucggggacgcgguacugggccccugaugcucgcaccacaacuuauaacgccggccgauuuucaaccccacagccgagcgagacacugcccggccguaucaauccuagaaccccaacucccgcaagggggaguuccucuacaagcuccaacgcuucaaccgccacgaguauucauagcaaucaaacugugucuacccgguugggauccacagcggguucaggcacuaacguaagcagucucccuucuaccgcccgcacaagauccuggguggaggaccagaauaggagccugucgccauucaugcgcggggcacacaacaucucuuuugucacgcccccuuccucacggaguagcucccagggaaccgugucuacuguuccaaaagaagugcuggauagcuggacaggcgcuuucaauacccgaagacaaccgcucuuugcccauauaaggcggcguggugagucacgcgucuga

SEQ ID NO: 21956 - RNA, 807 nt, Artificial Sequence; identical to SEQ ID NO: 21949
  derived and/or modified sequence opt3 from capsid_protein_VP2__Norovirus__AGE89617

SEQ ID NO: 21957 - RNA, 807 nt, Artificial Sequence; identical to SEQ ID NO: 21857
  derived and/or modified sequence opt3 from capsid_protein_VP2__Norovirus__AGE89620

SEQ ID NO: 21958 - RNA, 807 nt, Artificial Sequence
  derived and/or modified sequence opt3 from capsid_protein_VP2__Norovirus__AGE89623
auggccggcgcuuucuuugcagggcuggccagcgacgugcucggauccggucuuggcucucugaucaacgcgggggcuggagccauuaaucagaaggucgaguucgaaaacaauagaaaauugcaacaggcaucauuucaguucaguagcaacuuacagcaagccuccuuucagcacgauaaggagaugcugcaggcucagauagaagcaaccaaaaagcuacaacaggagaugaugaggguuaaacaggccaugcuccuggaaggcgguuucucugagacagacgcugcccgcggggcgaucaaugcacccaugacuaagacgcuugauuggucgggaacccgguacugggccccugacgcucgaacaacuaccuauaacgccggccguuuuucaacaccacagccgagcggcgcacugcccgggagagcuaauuugagggccaccgugccugcgcggggaaguuccucuacuuucagcaacuccucaauugccacaaguguauacagcaaucaaaccacgucuacucgccucgguuccaccgcaggcucagggacaagcgugaguucucugccauccacugcuagaaccaggagcugggucgaggaucagaaccggaaucugucgcccuuuaugcgcggagcccauaacaucucuuaugugacaccuccauccucacgaaguagcucccagggcaccguuucuacggugcccaaggaaguccucgacagcuggacuggugcuuucaauacaagaaggcaaccuuuauuugcccacauucggaaacguggggagucacgcguguga

SEQ ID NO: 21959 - RNA, 807 nt, Artificial Sequence
  derived and/or modified sequence opt3 from capsid_protein_VP2__Norovirus__AGE89626
auggccggcgcuuucuuugcagggcuggccagcgacgugcucggauccggucuuggcucucugaucaacgcgggggcuggagccauuaaucagaaggucgaguucgaaaacaauagaaaauugcaacaggcaucauuucaguucaguagcaacuuacagcaagccuccuuucagcacgauaaggagaugcugcaggcucagauagaagcaaccaaaaagcuacaacaggagaugaugaggguuaaacaggccaugcuccuggaaggcgguuucucugagacagacgcugcccgcggggcgaucaaugcacccaugacuaagacgcuugauuggucgggaacccgguacugggccccugacgcucgaacaacuaccuauaacgccggccguuuuucaacaccacagccgagcggcgcacugcccgggagagcuaauuugagggccaccgugccugcgcggggaaguuccucuacuuucagcaacuccucaauugccacaaguguauacagcaaucaaaccacgucuacucgccucgguuccaccgcaggcucagggacaagcgugaguucucugccauccacugcuagaaccaggagcugggucgaggaucagaaccggaaucugucgcccuuuaugcgcggagcccauaacaucucuuucgugacaccuccauccucacgaaguagcucccagggcaccguuucuacggugcccaaggaaguccucgacagcuggacuggugcuuuuaauacaagaaggcaaccuuuauucgcccacauucggaaacguggggagucacgcguguga

SEQ ID NO: 21960 - RNA, 807 nt, Artificial Sequence
  derived and/or modified sequence opt3 from capsid_protein_VP2__Norovirus__AGE89629
auggccggcgcuuucuuugcagggcuggccagcgacgugcucggauccggucuuggcucucugaucaacgcgggggcuggagccauuaaucagaaggucgaguucgaaaacaauagaaaauugcaacaggcaucauuucaguucaguagcaacuuacagcaagccuccuuucagcacgauaaggagaugcugcaggcucagauagaagcaaccaaaaagcuacaacaggagaugaugaggguuaaacaggccaugcuccuggaaggcgguuucucugagacagacgcugcccgcggggcgaucaaugcacccaugacuaagacgcuugauuggucgggaacccgguacugggccccugacgcucgaacaacuaccuauaacgccggccguuuuucaacaccacagccgagcggcgcacugcccgggggagcuaauuugagagccaccgugccugcgagggguaguuccucuacuuucagcaacuccucaauugccacaaguguauacagcaaucaaaccacgucuacucggcucggcuccaccgcagggucaggaacaagcgugaguucucugccauccacugcucgcaccagaagcugggucgaggaucagaacaggaaucugucgcccuuuaugcggggcgcccauaacaucucuuucgugacaccuccauccucacgcaguagcucccaggguaccguuucuacggugcccaaggaaguccucgacagcuggacuggggcuuuuaauacacgaagacaaccuuuauucgcccacauuaggaaacggggagagucacguguguga

SEQ ID NO: 21961 - RNA, 807 nt, Artificial Sequence; identical to SEQ ID NO: 21842
  derived and/or modified sequence opt3 from capsid_protein_VP2__Norovirus__AGE89635

SEQ ID NO: 21962 - RNA, 807 nt, Artificial Sequence
  derived and/or modified sequence opt3 from capsid_protein_VP2__Norovirus__AGE89638
auggccggcgcuuucuuugcagggcuggccagcgacgugcucggauccggucuuggcucucugaucaacgcgggggcuggagccauuaaucagaagauagauuucgagaacaauagaaaauugcaacaggcaucauuucaguucaguagcaacuuacagcaagccuccuuucagcacgacaaggaaaugcugcaggcucagaucgaggcaaccaaaaagcuacaacaggaaaugaugaaagucaagcaggccaugcuccuggagggcgguuucucugaaacagaugcugccaggggagcgauuaaugcacccaugacuaagguucuugacuggucggggacgcgguacugggccccugaugcucgcaccacaacuuauaacgccggccgauuuucaaccccacagccgagcggcacacugcccgggcguaucaauccuagaaccccaacucccgcaaggggaaguuccucuacaagcuccaacgcuucaaccgccacgaguauucauuugaaucaaacugugagcacccggcucgguucuacagcgggcuccgggacuaacguaucaagccugccuaguaccgcccgcacaagaucuuggguggaggaccagaauaggaaccuguccccauucaugcggggagcacacaauaucagcuuugucacgcccccuucgucucgcuccucaagucagggcaccgugagcacuguuccaaaagaggugcucgauuccuggacaggugcuuucaacacccgaagacaaccguuauuugcccauauaaggcggcguggggaaucucgcgucuga

SEQ ID NO: 21963 - RNA, 807 nt, Artificial Sequence
  derived and/or modified sequence opt3 from capsid_protein_VP2__Norovirus__AGE89641
auggccggcgcuuucuuugcagggcuggccagcgacgugcucggauccggucuuggcucucugaucaacgcgggggcuggagccauuaaucagaagauagauuucgagaacaauagaaaauugcaacaggcaucauuucaguucaguagcaacuuacagcaagccuccuuucagcacgacaaggaaaugcugcaggcucagaucgaggcaaccaaaaagcuacaacaggaaaugaugaaagucaagcaggccaugcuccuggagggcgguuucucugaaacagaugcugccaggggagcgauuaaugcacccaugacuaagguucuugacuggucggggacgcgguacugggccccugaugcucgcaccacaacuuauaacgccggccgauuuucaaccccacagccgagcggcacacugcccgggcguaucaauccuagaaccccaacucccgcaaggggaaguuccucuacaagcuccaacgugucaaccgcuacgaguauuuacagcaaucaaacuguaucuacccgguuggguuccacagccggcucagggacuaacgugagcagucucccuucuaccgcgcgcacaagauccugggucgaggaccagaauaggaaccugagcccauucaugcggggagcccauaauaucucguuugugacgcccccuucuucccgcucaaguagccagggcaccguuuccacugugccaaaagagguccuggauucuuggacaggugcauucaacacccgaagacaaccgcucuuugcucacauaaggcggcguggggaaagccgcguguga

SEQ ID NO: 21964 - RNA, 807 nt, Artificial Sequence
  derived and/or modified sequence opt3 from capsid_protein_VP2__Norovirus__AGE89644
auggccggcgcuuucuuugcagggcuggccagcgacgugcucggauccggucuuggcucucugaucaacgcgggggcuggagccauuaaucagaagauagauuucgagaacaauagaaaauugcaacaggcaucauuucaguucaguagcaacuuacagcaagccuccuuucagcacgacaaggaaaugcugcaggcucagaucgaggcaaccaaaaagcuacaacaggaaaugaugaaagucaagcaggccaugcuccuggagggcgguuucucugaaacagaugcugccaggggagcgauuaaugcacccaugacuaagguucuugacuggucggggacgcgguacugggccccugaugcucgcaccacaacuuauaacgccggccgauuuucaaccccacagccgagcggcgcacugcccgggcguaucaauccuagaacaccaacccccgcuaggggaaguuccucuacuagcuccaacgccucaacagcgaccaguauucauagcaaucaaacggugucuacucgguuggguuccaccgccggcucagggacaaacguaagcggacucccuaguacugcacgcaccagaucuuggguggaggaccagaauaggaaccuguccccauucaugcggggcgcucacaauaucagcuuugucacacccccuucgucucgcuccucaagucaggguaccgugagcacgguuccaaaagaggugcuggauuccuggacuggggccuucaacacacgaagacaaccgcucuuugcucauauaaggcggcguggagaaucucgcgucuga

SEQ ID NO: 21965 - RNA, 807 nt, Artificial Sequence
  derived and/or modified sequence opt3 from capsid_protein_VP2__Norovirus__AGE89647
auggccggcgcuuucuuugcagggcuggccagcgacgugcucggauccggucuuggcucucugaucaacgcgggggcuggagccauuaaucagaagauagauuucgagaacaauagaaaauugcaacaggcaucauuucaguucaguagcaacuuacagcaagccuccuuucagcacgacaaggaaaugcugcaggcucagaucgaggcaaccaaaaagcuacaacaggaaaugaugaaagucaagcaggccaugcuccuggagggcgguuucucugaaacagaugcugccaggggagcgauuaaugcacccaugacuaagguucuugacuggucggggacgcgguacugggccccugaugcucgcaccacaacuuauaacgccggccgauuuucaaccccacagccgagcggcacacugcccgggcguaucaauccuagaaccccaacucccgcaaggggaaguuccucuauuagcuccaacgcuucaacagccaccaguauccauagcaaucaaacggugucuacucgguuggguuccaccgcgggcucagggacaaacguaagcaguuucccuucuacugcccgcaccagauccuggguggaggaccagaauaggaaccucagcccauuuaugcggggagcacacaauauaucguucgucacacccccuucuucccgcucaaguagccagggcaccguguccacgguuccaaaagaggugcuggauucuuggacuggugcuuuuaacacacgaagacaaccgcuguucgcccauaucaggcggcguggggaaagccgcgucuga

SEQ ID NO: 21966 - RNA, 807 nt, Artificial Sequence; identical to SEQ ID NO: 21940
  derived and/or modified sequence opt3 from capsid_protein_VP2__Norovirus__AGE89650

SEQ ID NO: 21967 - RNA, 807 nt, Artificial Sequence
  derived and/or modified sequence opt3 from capsid_protein_VP2__Norovirus__AGE89653
auggccggcgcuuucuuugcagggcuggccagcgacgugcucggauccggucuuggcucucugaucaacgcgggggcuggagccauuaaucagaaggucgaguucgaaaacaauagaaaauugcaacaggcaucauuucaguucaguagcaacuuacagcaagccuccuuucagcacgauaaggagaugcugcaggcucagauagaagcaaccaaaaagcuacaacaggagaugaugaggguuaaacaggccaugcuccuggaaggcgguuucucugagacagacgcugcccgcggggcgaucaaugcacccaugacuaaggcccuugauuggucgggaacgcgguacugggcuccugacgcccgaaccacaacuuauaacgcaggccauuuuucaaccccacagagcaguggcgcucugccggggcgugccaauuugagagcggccgugcccgcaaggggauccucuagcacauccucaaacaguagcaccgcuacuucuguauacuccaaucaaacaauuucaacccggcucgguagcacggccggcagugggacuucuguguccagccugccuucgaccgcucgcacaagaucuugggucgaggaucagaacaggaaucuguccccauucaugcggggagcccacaacaucucauuugugacucccccuaguagccgcccauccucucagggcaccguuagcacagugcccaaggaaguccucgacucauggaccggugcauucaauacgcgaagacaaccuuuauuugcccauauuaggaaacguggggagagucgggcuuga

SEQ ID NO: 21968 - RNA, 807 nt, Artificial Sequence; identical to SEQ ID NO: 21850
  derived and/or modified sequence opt3 from capsid_protein_VP2__Norovirus__AGE89656

SEQ ID NO: 21969 - RNA, 807 nt, Artificial Sequence
  derived and/or modified sequence opt3 from capsid_protein_VP2__Norovirus__AGE89659
auggccggcgcuuucuuugcagggcuggccagcgacgugcucggauccggucuuggcucucugaucaacgcgggggcuggagccauuaaucagaagauagauuucgagaacaauagaaaauugcaacaggcaucauuucaguucaguagcaacuuacagcaagccuccuuucagcacgacaaggaaaugcugcaggcucagaucgaggcaaccaaaaagcuacaacaggaaaugaugaaagucaagcaggccaugcuccuggagggcgguuucucugaaacagaugcugccagaggggcgauuaaugcacccaugacuaagguucuugacuggucgggaacgcgguacugggccccugaugcucgcaccacaacuuauaacgccggccgauuuucaaccccacagccgagcggcacacugcccgggcguaucaauccuaggauuccaacccccgcaaggggaaguuccucuacuagcuccaacgcuucaacagccaccaguaucuacagcaaucaaacggugucuacucgguuggguuccgcggccggcucagggaccaacguaagcagucucccuucuacagcacgcacuagauccuggguggaggaccagaauaggaaccugagcccauucaugcggggagcucauaauauaucguuugucacacccccuucuucccgcucaaguagccagggcaccguguccaccguuccaaaagaggugcuggauucuuggacgggugccuucaacacucgaagacaaccgcucuuugcucacaucaggcggcguggggaaagccgcgucuga

SEQ ID NO: 21970 - RNA, 807 nt, Artificial Sequence
  derived and/or modified sequence opt3 from capsid_protein_VP2__Norovirus__AGE89662
auggccggcgcuuucuuugcagggcuggccagcgacgugcucggauccggucuuggcucucugaucaacgcgggggcuggagccauuaaucagaagauagauuucgagaacaauagaaaauugcaacaggcaucauuucaguucaguagcaacuuacagcaagccuccuuucagcacgacaaggaaaugcugcaggcucagaucgaggcaaccaaaaagcuacaacaggaaaugaugaaagucaagcaggccaugcuccuggagggcgguuucucugaaacagaugcugccaggggagcgauuaaugcacccaugacuaagguucuugacuggucggggacgcgguacugggccccugaugcucgcaccacaacuuauaacgccggccgauuuucaaccccacagccgagcggcacacugcccgggcguaucaauccuagaaccccaacucccgcaaggggaaguuccaacacaucuagcaaugcuuccaccgccacgucaauucauaguaaccaaacugugagcacccgguuggguucuacagcgggcuccgggacuaauguaucaagccucccuaguaccgcccgcacaagaucuuggguggaggaccagaacaggaaucuguccccauucaugcggggagcacacaacaucagcuuugucacgcccccuucgucucgcuccucaagucagggcaccgugagcacuguuccaaaagaggugcuggauuccuggacaggugcuuucaauacccgaagacaaccgcucuuugcccauauaaggcggcguggggaaucucgcgucuga

SEQ ID NO: 21971 - RNA, 807 nt, Artificial Sequence; identical to SEQ ID NO: 21857
  derived and/or modified sequence opt3 from capsid_protein_VP2__Norovirus__AGE89665

SEQ ID NO: 21972 - RNA, 807 nt, Artificial Sequence; identical to SEQ ID NO: 21970
  derived and/or modified sequence opt3 from capsid_protein_VP2__Norovirus__AGE89668

SEQ ID NO: 21973 - RNA, 807 nt, Artificial Sequence
  derived and/or modified sequence opt3 from capsid_protein_VP2__Norovirus__AGE89671
auggccggcgcuuucuuugcagggcuggccagcgacgugcucggauccggucuuggcucucugaucaacgcgggggcuggagccauuaaucagaagauagauuucgagaacaauagaaaauugcaacaggcaucauuucaguucaguagcaacuuacagcaagccuccuuucagcacgacaaggaaaugcugcaggcucagaucgaggcaaccaaaaagcuacaacaggaaaugaugaaagucaagcaggccaugcuccuggagggcgguuucucugaaacagaugcugccaggggugcgauuucggcacccaugacuaagguucuugacuggucaggaacgcgguacugggccccugaugcucgcaccacaacuuauaauagcggccgauuuaguaccccacagccguccggcacacugcccgggcguaucaacccuagaaccccaacucccgccaggggaucuagcuccacaucaaguaaugcaagcaccgcuacgucuauucauuugaaccaaacuguguccacccggcucgguucaacagccggcagcgggacuaauguaaguucucugccuuccaccgcgcgcacaagaagcuggguggaggaccagaacaggaaucugucgccauucaugcggggagcccacaacaucucuuuugucacgcccccuuccucacgcaguagcucccagggcaccgugucuacuguuccaaaagagauacucgauagcugggcaggggcuuucaauacacgaagacaaccguuauuugcccauaucaggcggcguggggaaucacgcguguga

SEQ ID NO: 21974 - RNA, 807 nt, Artificial Sequence; identical to SEQ ID NO: 21970
  derived and/or modified sequence opt3 from capsid_protein_VP2__Norovirus__AGE89674

SEQ ID NO: 21975 - RNA, 807 nt, Artificial Sequence
  derived and/or modified sequence opt3 from capsid_protein_VP2__Norovirus__AGE99604
auggccggcgcuuucuuugcagggcuggccagcgacgugcucuccucuggacuugguucacugaucaacgcgggcgcuggggccauuaaucagaagauagauuucgagaacaauagaaaauugcaacaggcaaguuuucaguucagcuccaacuuacagcaagccucuuuucagcacgacaaggaaaugcugcaggcucagaucgaggcaaccaaaaagcuacaacaggaacucaugaaagucaagcagacaauucugcuugagggaggcuucucggaaacugaugccgcuaggggugccaucaaugcgcccaugacgaaggcacuggacuggucagggacccgguacugggccccugaugcucgcacaacuaccuauaacgccggacgauuuagcacaccacagccgaguggcgcauugcccggccguauuaauccuagaaccccaauccccgcuaggggguccccuucuauaagcuccaacgccucaacugcgacaaguauccauagcaaucaaaccgccucuacgcggcucggauccacugcagguucaggcaccaacguuagcagucugccaucuacagcucgcacuagauccuggguggaggaccagaauaggaaccugagccccuucaugcgcggggcccacaauauuucguuuguaaccccuccaucuucccggucaaguagccagggaacaguguccaccgucccgaaagaugugcucgacucuuggacgggcgcuuucaacacucgaagacaacccuuauuugcccauaucaggcggcguggugagagccgcguuuga

SEQ ID NO: 21976 - RNA, 807 nt, Artificial Sequence
  derived and/or modified sequence opt3 from capsid_protein_VP2__Norovirus__AGE99607
auggccggccccuucuuugcugggcuggcaagcgacgugcucggauccggucuuggcucucugaucucagccggggcgggagcuauuaaccagaaggucgaguucgaaaauaacagaaaauugcaacaggccaguuuucaguucagcuccaauuuacagcaagcaucuuuucagcacgauaaggagaugcugcaggcccagauagaagcuacccaaaaacuacagcaggagcucaugaagguuaaacaggcagugcugcuugaaggcgguuucucgacaacugacgccgcuaggggagccaucaacgcgccuaugacgaaggcacuggauuggucagggacccgguacugggccccagacgcucgcauuacaacuuauaaugccggccgauuuagcaccccgcaacccuugggcgcacucccugggcguacaaacccaagaguacccgcuagugccagguccucuccuagcucccugucaaaugcgccaaccgccacaaguguguacagcaaccagacugcaucuacccggcugggauccucagcugguagcggcgccggggucaguucucuccccuccacggcucgcacuagaagcuggguggaggaucagaauaagaacuuaucgccuuucaugaaaggagcccugaauaccucuuuuguuacaccaccguccucaaggaguagcaaccaaggcacuguguccaccguccccaaggagauccuugacucuuggacaggugcauucaauacccggcgccagccuuuguuugcccauauucgaaaaagaggggaaagcaggguguga

SEQ ID NO: 21977 - RNA, 807 nt, Artificial Sequence
  derived and/or modified sequence opt3 from capsid_protein_VP2__Norovirus__AGK36312
auggccggcgcuuucuuugcagggcuggccagcgacgugcucggauccggucuuggcucucugaucaacgcgggggcuggagccauuaaucagaagauagauuucgagaacaauagagaauugcaacaggcaucauuucaguucaguagcaacuuacagcaagccuccuuucagcacgacaaagagaugcugcaggcucagaucgaagcaaccaagaaacuacaacaggagaugaugaaggucaaacaggccaugcuccuggaaggcgguuucucugagacagaugcugccaggggagcgauuaaugcacccaugacuaagguucuugacuggucggggacgcgguacugggccccugaugcucgcaccacaacuuauaacgccggccgauuuucaaccccacagccgagcggcacacugcccgggcguaucaauccuagaaccccaacucccgcaaggggaaguuccucugcuagcuccaacgccucaacagcgaccaguauuuacagcaaucaaacggugucuacucgguuggguuccaccgccggcucagggacaaacguaagcagucucccuucuacugcacgcaccagauccuggguggaggaccagaauaggaaccugagcccauucaugcggggagcucauaauaucucguuugucacacccccuucuucccgcucaaguagccagggcaccguguccacgguuccaaaggaagugcuggauucuuggacuggugccuucaacacacgaagacaaccgcucuuugcucacauaaggcggcguggggagagccgcgucuga

SEQ ID NO: 21978 - RNA, 807 nt, Artificial Sequence; identical to SEQ ID NO: 21949
  derived and/or modified sequence opt3 from capsid_protein_VP2__Norovirus__AGK36315

SEQ ID NO: 21979 - RNA, 639 nt, Artificial Sequence
  derived and/or modified sequence opt3 from capsid_protein_VP2__Norovirus__AGM33209
auggcccaggcuaucauuggcgcaauagccgcgagcaccgcuggguccgcccugggagcagguauccaagugggcggggaggccgcucuccagucucagagauaccagcaaaaccuucagcugcaggaaaauucauucaagcacgacagggagaugauuggauaucaggucgaagcaaguaaccaauuguuagccaaaaaucuggcuacacgguacagccuacuccgcgccggcggucugacuuccgcggaugcagcccgaucuguugcuggggcccccgugacgcguaucguagacuggaacggagugagagucucggcaccugagucaagcgcuaccacacuuaggaguggcggcuuuauguccgugccaauuccguucgccucuaagcagaaacagguucagagcuccgggaucucaaaucccaacuauaguccuagcucuauaucccggacuaccucauggguggaaagccaaaauaguucucgcuuuggaaaccuguccccauaccaugcggaggccuugaauacagucuggcucacucccccugguagcaccgcaucgucuacacuguccucagugccaagaggcuauuucaacaccgauaggcugccccucuuugcuaauaaccggcgcuga

SEQ ID NO: 21980 - RNA, 639 nt, Artificial Sequence
  derived and/or modified sequence opt3 from capsid_protein_VP2__Norovirus__AGM33215
auggcccaggcuaucauuggcgcaauagccgcgagcaccgcuggguccgcccugggagcagguauccaagugggcggggaggccgcucuccagucucagagauaccagcaaaaccuucagcugcaggaaaauucauucaagcacgacagggagaugauuggauaucaggucgaagcaaguaaccaauuguuagccaaaaaucuggcuacacgguacagccuacuccgcgccggcggucugacuuccgcggaugcagcccgaucuguugcuggggugcccguaacgcguaucguggacuggaacggagucagagugucggccccugagucaagcgcaaccacacuuaggaguggcggcuuuauguccguuccaauuccguucgcuucuaagcagaaacaggugcagagcuccgggaucucaaaucccaacuauaguccuagcucuauaucccggacuaccucaugggucgaaagccaaaauaguucucgcuuuggaaaccuguccccauaccaugccgaggcguugaauacaguguggcucacucccccugguagcaccgccucgucuacacuguccucaguaccaagaggcuauuucaacaccgauaggcugccccucuuugcaaauaaccggcgcuga

SEQ ID NO: 21981 - RNA, 639 nt, Artificial Sequence; identical to SEQ ID NO: 21979
  derived and/or modified sequence opt3 from capsid_protein_VP2__Norovirus__AGM33218

SEQ ID NO: 21982 - RNA, 639 nt, Artificial Sequence; identical to SEQ ID NO: 21979
  derived and/or modified sequence opt3 from capsid_protein_VP2__Norovirus__AGM33221

SEQ ID NO: 21983 - RNA, 639 nt, Artificial Sequence; identical to SEQ ID NO: 21980
  derived and/or modified sequence opt3 from capsid_protein_VP2__Norovirus__AGM33224

SEQ ID NO: 21984 - RNA, 639 nt, Artificial Sequence; identical to SEQ ID NO: 21979
  derived and/or modified sequence opt3 from capsid_protein_VP2__Norovirus__AGM33227

SEQ ID NO: 21985 - RNA, 639 nt, Artificial Sequence; identical to SEQ ID NO: 21980
  derived and/or modified sequence opt3 from capsid_protein_VP2__Norovirus__AGM33230

SEQ ID NO: 21986 - RNA, 639 nt, Artificial Sequence
  derived and/or modified sequence opt3 from capsid_protein_VP2__Norovirus__AGM33233
auggcccaggcuaucauuggcgcaauagccgcgagcaccgcuggguccgcccugggagcagguauccaagugggcggggaggccgcucuccagucucagagauaccagcaaaaccuucagcugcaggaaaauucauucaagcacgacagggagaugauuggauaucaggucgaagcaaguaaccaauuguuagccaaaaaucuggcuacacgguacagccuacuccgcgccggcggucugacuuccgcggaugcagcccgaucuguugcuggggugcccguaacgcguaucguggacuggaacggagucagagugucggccccugagucaagcgcaaccacacuuaggaguggcggcuuuauguccguuccaauuccguucgcuucuaagcagaaacagauccagagcuccgggauaucaaaucccaacuauaguccuagcucuaucucccggacuaccucauggguggaaagccaaaauaguucucgcuuuggaaaccuguccccauaccaugccgaggcguugaauacagucuggcucacucccccugguagcaccgccucgucuacacuguccucagugccaagaggcuauuucaacaccgauaggcugccccucuuugcaaauaaccggcgcuga

SEQ ID NO: 21987 - RNA, 639 nt, Artificial Sequence; identical to SEQ ID NO: 21979
  derived and/or modified sequence opt3 from capsid_protein_VP2__Norovirus__AGM33236

SEQ ID NO: 21988 - RNA, 639 nt, Artificial Sequence; identical to SEQ ID NO: 21979
  derived and/or modified sequence opt3 from capsid_protein_VP2__Norovirus__AGM33239

SEQ ID NO: 21989 - RNA, 639 nt, Artificial Sequence; identical to SEQ ID NO: 21979
  derived and/or modified sequence opt3 from capsid_protein_VP2__Norovirus__AGM33242

SEQ ID NO: 21990 - RNA, 639 nt, Artificial Sequence; identical to SEQ ID NO: 21980
  derived and/or modified sequence opt3 from capsid_protein_VP2__Norovirus__AGM33245

SEQ ID NO: 21991 - RNA, 639 nt, Artificial Sequence; identical to SEQ ID NO: 21979
  derived and/or modified sequence opt3 from capsid_protein_VP2__Norovirus__AGT17786

SEQ ID NO: 21992 - RNA, 639 nt, Artificial Sequence; identical to SEQ ID NO: 21979
  derived and/or modified sequence opt3 from capsid_protein_VP2__Norovirus__AGT17793

SEQ ID NO: 21993 - RNA, 807 nt, Artificial Sequence
  derived and/or modified sequence opt3 from capsid_protein_VP2__Norovirus__AGT17796
auggccggcgcuuucuuugcagggcuggccagcgacgugcucggauccggucuuggcucucugaucaacgcgggggcuggagccauuaaucagaaggucgaguucgaaaacaauagaaaauugcaacaggcaucauuucaguucaguagcaacuuacagcaagccuccuuucagcacgauauagagaugcugcaggcucagaucgaagcaaccaagaaacuacaacaggagaugaugagggccaagcaggcuaugcuccuggaaggcgguuucucugagacagacgccgcgcgcggggcaauuaaugcccccaugacuaaaacgcuugauuggucgggaacccgguacugggcuccugacgcccgaacaacuaccuauaacgcaggccguuuuucaacaccacagccgagcggcgcucaacccgggagagccaaucugagggcgaccguuccugcccggggaaguuccucuacuagcuccaacucaaguaucgcaacaagcguguacucuaaucagaccacguccacucgcuuggguucaaccgcuggcagcgggacaaguguaucuucccucccaagcacugccagaaccaggucguggguggaggaucagaaccggaaucugucucccuucaugcgcggagcucauaacauuuccuuugucacaccuccaucaagucgaagcuccucucaaggcaccgugagcacgguucccaaggaagugcuggacucauggacuggugccuucaauacaagaaggcagccucucuuugcacacauccggaagcguggggagagucgcgucuga

SEQ ID NO: 21994 - RNA, 807 nt, Artificial Sequence
  derived and/or modified sequence opt3 from capsid_protein_VP2__Norovirus__AGT17799
auggccggcgcuuucuuugcagggcuggccagcgacgugcucggauccggucuuggcucucugaucaacgcgggggcuggagccauuaaucagaaggucgaguucgaaaacaauagaaaauugcaacaggauucauuucaguucaguagcaacuuacagcaagcauccuuucagcacgacaaggagaugcugcaggcccagauagaagcuaccaaaaagcuacaacaggagaugaugaggguuaaacaggcaaugcuccuggaaggcgguuucucugagacagaugccgcucgcggggccaucaaugcgcccaugacuaaggugcuugacuggucgggaacgcgguacugggcaccuggcgcccgaaccacaacuuauaacgcuggcuacuuuucaaccccacagcauagcggggcccugccgggacgugcaaauuugagagcuguagugcccgccagggguaguucccgggucucuagcaacuccucaacagcgaccaguguguauagcaaucaaacugccucuacacgccucggcuccaccgcagggucaggaacgagcguuaguucucugccuuccacugcuagaaccaggagcuggguggaggaucagaaccggaaucugucgccauucaugcgcggcgcccacaacauuucuuuugucacacccccuuccucacgaaguagcucccaggguacugugucuaccguaccaaaggaaguucucaauagccaagcugggguguucaacacaagaaggcagcccuuauuugcccauauccggcgucgcggagagucaagagcauga

SEQ ID NO: 21995 - RNA, 639 nt, Artificial Sequence; identical to SEQ ID NO: 21979
  derived and/or modified sequence opt3 from capsid_protein_VP2__Norovirus__AGT17804

SEQ ID NO: 21996 - RNA, 639 nt, Artificial Sequence; identical to SEQ ID NO: 21979
  derived and/or modified sequence opt3 from capsid_protein_VP2__Norovirus__AGT17807

SEQ ID NO: 21997 - RNA, 639 nt, Artificial Sequence; identical to SEQ ID NO: 21979
  derived and/or modified sequence opt3 from capsid_protein_VP2__Norovirus__AGT17810

SEQ ID NO: 21998 - RNA, 807 nt, Artificial Sequence
  derived and/or modified sequence opt3 from capsid_protein_VP2__Norovirus__AGT17814
auggccggcgcuuucuuugcagggcuggccagcgacgugcucggauccggucuuggcucucugaucaacgcgggggcuggagccauuaaucagaaggucgaguucgaaaacaauagaaaauugcaacaggcaucauuucaguucaguagcaacuuacagcaagccuccuuucagcacgauaaggagaugcugcagucucagauagacgcuaccaaaaagcuacaacaggaaaugaugaggguuaaacaggcaaugcuccuggagggcgguuucucggaaacagaugccgcucgcggggccaucaaugcgcccaugacuaaggugcuugacuggucaggaacgcgguacugggcaccugaugcccgaaccacaacuuauaacgcuggccguuuuagcaccccacagccgaguggcgcacccccugggagagccaaucugagggcugccguaccagcgcggggauccucuagcacauccucaaacaguagcauugccaccucuauguacuccaaucaaacuacaucaacccgcuuggguagcacggcaggcagugggacuucuguguccagccuccccucgucugcuagaaccagguccugggucgaggaccagaaccggaaucugucaccuuucaugcgcggagcccauaacaucaguuuugugacaccacccagcucccgaucuagcucacagggcacuguuaguaccgugccuaaggagguccuggauuccuggacaggugcuuucaauaccagaaggcaaccacucuuugcccacauucggcgucgcggggaaagcagaguguga

SEQ ID NO: 21999 - RNA, 807 nt, Artificial Sequence
  derived and/or modified sequence opt3 from capsid_protein_VP2__Norovirus__AGT17820
auggccggcgcuuucuuugcagggcuggccagcgacgugcucggauccggucuuggcucucugaucaacgcgggggcuggagccauuaaucagaaggucgaguucgaaaacaauagaaaauugcaacaggcaucauuucaguucaguagcaacuuacagcaagccuccuuucagcacgauaaggagaugcugcaggcucagauagaagcaaccaaaaagcuacaacaggagaugaugagggccaaacaggcuaugcuccuggaaggcgguuucucugagacagacgccgcgcgcggggcaaucaaugcccccaugacuaagacgcuugauuggucgggaacccgguacugggcuccugacgcccgaacaacuaccuauucagcaggccguuuuagcacaccacagccgaguggcgcucugcccgggagagccaacuugagggcgaccguuccugcccggggauccucuagcacuuccucaaauaguagcauugcaacaucuguguacuccaaccaaaccacgucaacucgccucgguagcaccgcuggcagugggacaucuguauccagccugccaucgacugccagaaccaggucuuggguggaggaucagaaucggaaccugucccccuucaugcgcggagcucauaauaucucauuugucacaccuccaaguagccgauccucuagccagggcaccgugucaacgguucccaaggaagugcucgacaguuggacuggugccuucaacacaagaaggcaaccuuuauuugcacacauucggaaacguggggagucccgcgucuga

SEQ ID NO: 22000 - RNA, 807 nt, Artificial Sequence
  derived and/or modified sequence opt3 from capsid_protein_VP2__Norovirus__AGT17824
auggccggcgcuuucuuugcagggcuggccagcgacgugcucggauccggucuuggcucucugaucaacgcgggggcuggagccauuaaucagaaggucgaguucgaaaacaauagaaaauugcaacaggauucauuucaguucaguagcaacuuacagcaagcauccuuucagcacgacaaggagaugcugcaggcccagauagaagcuaccaaaaagcuacaacaggagaugaugaggguuaaacaggcaaugcuccuggaaggcgguuucucugagacagaugccgcucgcggggccaucaaugcgcccaugacuaaggugcuugacuggucgggaacgcgguacugggcaccugaugcccgaaccacaacuuauaacgcuggccauuuuucaaccccacagcacagcggcgcccugccggggcgugcaaauuugagagcuacaguacccgccaggggaaguucccgggcgucuagcaacuccucaaccgccaccaguguguacagcaaucaaacaaccucuacgcgccucgguuccacugcaggcucagggaccagcgucaguucucugccuuccacagcuagaacuaggagcuggguggaggaccagaaccggaaucugucgccauucaugcgcggagcccauaacauuucuuuuguuacucccccuuccucacgaaguagcucccagggcacagugucuaccgucccaaaggaagugcucaauagcagaacgggugcuuucaacacuaggcggcaacccuuauuugcccacauccgucgccagggggagucaagagcauga

SEQ ID NO: 22001 - RNA, 639 nt, Artificial Sequence; identical to SEQ ID NO: 21979
  derived and/or modified sequence opt3 from capsid_protein_VP2__Norovirus__AGT17827

SEQ ID NO: 22002 - RNA, 807 nt, Artificial Sequence
  derived and/or modified sequence opt3 from capsid_protein_VP2__Norovirus__AGT17831
auggccggcgcuaucauugcagggcuggccagcgacgugcucuccucuggacuugguucacugauaaacgcgggcgcuggggucaucaaucagaagguugauuucgagaacaauaaacaauugcagcagaacaguuuucaguucagcuccaauuuacaacaggccucuuuucagcacgacaaggaaaugcugcaggcacaaauugaggccaccaaaaagcuacagcaggaaaugaugggaaucaaacaggcugugcuccugaagggcgguuucucggagacagaugcagccagaggggcuguaaacgcccccaugacuaaggugcuugacuggucaggaacgagguacugggcgccuaaugcaagcaccacaacuuauaacgccggccgguuuaguaccccacaaccguccggcgcucugcccgggcgcacaaauuugcgaaccgccgcuccugcacguggaucuccaagcauuuccucaaacgccaguacugcgacaagcgucuacucuaaucagaccguguccacgagacucgguacuucagccggcagcgggaccaguguuucuucccugcccagcacagcaaggacucggucguggguggaagaucagaaccgcaaucugucuccuuucaugagaggagcucauaacaucuccuuugucaccccacccucaaguaggagcuccucucaaggcacagugagcaccguaccuaaagagguucucgacucauggacgggugccuucaauacucggcgccagccauuauuugcucacauacgaaagagaggggagaguaggguguga

SEQ ID NO: 22003 - RNA, 639 nt, Artificial Sequence; identical to SEQ ID NO: 21979
  derived and/or modified sequence opt3 from capsid_protein_VP2__Norovirus__AGT17837

SEQ ID NO: 22004 - RNA, 807 nt, Artificial Sequence
  derived and/or modified sequence opt3 from capsid_protein_VP2__Norovirus__AGT17843
auggccggcgcuuucuuugcagggcuggccagcgacgugcucggauccggucuuggcucucugaucaacgcgggggcuggagccauuaaucagaaggucgaguucgaaaacaauagaaaauugcaacaggauucauuucaguucaguagcaacuuacagcaagcauccuuucagcacgacaaggagaugcugcaggcccagauagaagcuaccaaaaagcuacaacaggagaugaugaggguuaaacaggcaaugcuccuggaaggcgguuucucugagacagaugccgcucgcggggccaucaaugcgcccaugacuaaggugcuugacuggaacggaacgcgguacugggcaccuggcgcccgaaccacaacuuauaaugcuggccauuuuucgaccccacagcacucaggggcccugccgggacgugcaaacuugagagcugccguacccgcgagggguagcagucgggccuccucuaauagcuccacagcaaccucaguguacaguaaccaaacuacaagcacccgccucggcucuacggcuggguccggaacuucagucagcagucugccuucuaccgccagaacaagguccuggguggaggaucagaaucggaaccugagcccauucaugcgcggcgcucauaauauuucguuuguuacucccccuucuucccgaucaaguagccaggguaccguguccacagucccaaaggaagugcucaacucucaaaccggggccuucaauacgagaaggcagcccuuauuugcacacauccggcgucgcggagagagcagagccuga

SEQ ID NO: 22005 - RNA, 807 nt, Artificial Sequence
  derived and/or modified sequence opt3 from capsid_protein_VP2__Norovirus__AGX85887
auggccggcgcuuucuuugcagggcuggccagcgacgugcucuccucuggacuugguucacugaucaacgcgggcgcuggggccauuaaucagaccgucgaguucgaaaacaauagaaaguugcaacaggcaaguuuucaguucagcuccaacuuacagcaagccucuuuucagcacgauaaagagaugcugcagucgcagauagacgcuacaaagaaacuacaacaggaaaugaugaggguuaagcaggcaaugcuccuggagggaggcuucucagaaacugaugccgcucggggugccaucaaugcgcccaugacgaaagugcuugacuggagcgggacccgcuacugggcaccugaugcccgaacaacuaccuauaacgcuggacguuuuaguacaccacaguccucuggcgccccgcccggcagagcaaaucugagggcugccguaccugcgcaagggagcuccucaaccaguagcaacucuuccauugccacuucaauguacagcaaucagacaaccaguacgcgguugggaucuacugcagguuccggcaccagcgugucgucucucccauccucagcucgcacaagaaguugggucgaggaccagaacaggaaucugagccccuucaugcgcggggcccauaacaucuccuuugugacuccuccaucuagccggucaaguucccaaggaaccguuagcacagugcccaaggagguccuggauucuuggaccggcgcuuucaauacgcgaagacagccucucuuugcccacauuaggcggcguggugaaucacgcguguga

SEQ ID NO: 22006 - RNA, 807 nt, Artificial Sequence
  derived and/or modified sequence opt3 from capsid_protein_VP2__Norovirus__AGX85893
auggccggcgcuuucuuugcagggcuggccagcgacgugcucggauccggucuuggcucucugaucaacgcgggggcuggagccauuaaucagaaggucgaguucgaaaacaauagaaaauugcaacaggauucauuucaguucaguagcaacuuacagcaagcauccuuucagcacgacaaggagaugcugcaggcccagauagaagcuaccaaaaagcuacaacaggagaugaugaggguuaaacaggcaaugcuccuggaaggcgguuucucugagacagaugccgcucgcggggccaucaaugcgcccaugacuaaggugcuugacuggucgggaacgcgguacugggcaccuggcgcccgaaccacaacuuauaacgcuggcuacuuuucaaccccacagcauagcggggcccugccgggacgugcaaauuugagagcugccguacccgcgagggguaguucccgggugucuagcaacuccucaacagccaccagugucuauagcaaucaaacugcaucuacacgccucggcuccaccgcugggucaggaacgagcgugaguucucugccuuccacugccagaaccaggagcuggguugaggaucagaaccggaaucugucgccauucaugcgcggcgcucacaacauuucuuuugugacacccccuuccucacgaaguagcucccaggguacugucucuaccgugccaaaggaaguacucaauagccaaacagggguuuucaacaccagaaggcagcccuuauuugcccauauccggcgucgcggagagucaagagcauga

SEQ ID NO: 22007 - RNA, 807 nt, Artificial Sequence
  derived and/or modified sequence opt3 from capsid_protein_VP2__Norovirus__AGX85896
auggccggcgcuuucuuugcagggcuggccagcgacgugcucggauccggucuuggcucucugaucaacgcgggggcuggagccauuaaucagaaggucgaguucgaaaacaauagaaaauugcaacaggauucauuucaguucaguagcaacuuacagcaagcauccuuucagcacgacaaggagaugcugcaggcccagauagaagcuaccaaaaagcuacaacaggagaugaugaggguuaaacaggcaaugcuccuggaaggcgguuucucugagacagaugccgcucgcggggccaucaaugcgcccaugacuaaggugcuugacuggucgggaacgcgguacugggcaccuggcgcccgaaccacaacuuauaacgcuggcuacuuuucaaccccacagcauagcggggcccugccgggacgugcaaauuugagagcugccguacccgcgagggguaguucccgggugucuagcaacuccucaacagccaccagugucuauagcaaucaaacugcaucuacacgccucggcuccaccgcugggucaggaacgagcgugaguucucugccuuccacugccagaaccaggagcuggguugaggaucagaaccggaaucugucgccauucaugcgcggcgcucacaacauuucuuuugugacacccccuuccucacgaaguagcucccaggguacugucucuaccgugccaaaggaaguacucaauagccaaacaggggccuucaacaccagaaggcagcccuuauuugcacauauccggcgucgcggagagucaagagccuga

SEQ ID NO: 22008 - RNA, 807 nt, Artificial Sequence
  derived and/or modified sequence opt3 from capsid_protein_VP2__Norovirus__AGX85905
auggccggcgcuuucuuugcagggcuggccagcgacgugcucuccucuggacuugguucacugaucaacgcgggcgcuggggccauuaaucagagaauagauuucgagaacaauaggaaguugcaacaggcaaguuuucaguucagcuccaacuuacagcaagccucuuuucagcacgacaaagaaaugcugcaggcucagaucgaggcaaccaagaaacuacaacaggaacucaugaaggucaaacaggccaugcugcuugagggaggcuucucggaaacagaugcugcccggggugcgauuaaugcacccaugacuaaggcccuggacuggucagggacgcgcuacugggcuccugaugcccgaaccacaacuuauaacgcaggacguuuuagcaccccacagccgaguggcgcuuugcccggcagaaucaauccuaggacaccaauucccgcccggggguccccuucuaucagcuccaacguuucaaccgcgaauaguauacauagcaaccaaacugccucuacacgccucggauccaccgcagguucaggcacggacgugagcagucugccaucuacugcuagaaccagguccuggguagaggaucagaaucggaaccugagccccuucaugcgcggggcccacaauaucucguuugugacaccuccaucuucccgaucaaguagccagggaacugucuccaccgugccgaaggacguucucgauucuuggacaggcgcuuucaacaccagaaggcaacccuuauuugcccauauucggcgucgcggugagagcagaguguga

SEQ ID NO: 22009 - RNA, 807 nt, Artificial Sequence
  derived and/or modified sequence opt3 from capsid_protein_VP2__Norovirus__AGX85914
auggccggcgcuuucuuugcagggcuggccagcgacgugcucggauccggucuuggcucucugaucaacgcgggggcuggagccauuaaucagaaggucgaguucgaaaacaauagaaaauugcaacaggauucauuucaguucaguagcaacuuacagcaagcauccuuucagcacgacaaggagaugcugcaggcccagauagaagcuaccaaaaagcuacaacaggagaugaugaggguuaaacaggcaaugcuccuggaaggcgguuucucugagacagaugccgcucgcggggccaucaaugcgcccaugacuaaggugcuugacuggucgggaacgcgguacugggcaccuggcgcccgaaccacaacuuauaacgcuggcuacuuuucaaccccacagcauagcggggcccugccgggacgugcaaauuugagagcuguagugcccgccagggguaguucccgggucucuagcaacuccucaacagcgaccaguguguauagcaaucaaacugccucuacacgccucggcuccaccgcagggucaggaacgagcguuaguucucugccuuccacugcuagaaccaggagcuggguggaggaucagaaccggaaucugucgccauucaugcgcggcgcccacaacauuucuuuugucacacccccuuccucacgaaguagcucccaggguacugugucuaccguaccaaaggaaguucucaauagccaaacagggguguucaacaccagaaggcagcccuuauuugcucauauccggcgucgcggagagucaagagccuga

SEQ ID NO: 22010 - RNA, 807 nt, Artificial Sequence; identical to SEQ ID NO: 22005
  derived and/or modified sequence opt3 from capsid_protein_VP2__Norovirus__AGX85917

SEQ ID NO: 22011 - RNA, 807 nt, Artificial Sequence; identical to SEQ ID NO: 22002
  derived and/or modified sequence opt3 from capsid_protein_VP2__Norovirus__AGX85923

SEQ ID NO: 22012 - RNA, 807 nt, Artificial Sequence
  derived and/or modified sequence opt3 from capsid_protein_VP2__Norovirus__AGX85926
auggccggcgcuaucauugcagggcuggccagcgacgugcucuccucuggacuugguucacugauaaacgcgggcgcuggggccaucaaucagaccauugauuucgagaacaauagaaaguugcaacaggcaaguuuucaguucagcuccaacuuacagcaagccucuuuucagcacgacaaagaaaugcugcaggcucagaucgaggcaacaaagaaacuacaacaggaaaugaugagggucaagcaggccaugcuccuggagggaggcuucucggaaacugaugcugcccggggugcgauuaaugcacccaugacgaaaacccuugacuggucagggacacgcuacugggccccugaugcucgaacuaccacauauaacgccggacguuuuagcaccccacagccgaguggcgcacccccuggcagagcuaaucugagggccacuacaccagcgcggggguccucuagcaccuccucaaacaguagcaucgccacgucuguuuacuccaaucaaacuaccucaacacgcuugggaagcacugcagguaguggcaccucuguguccagccuccccucgacagcuagaaccaggucuuggguagaggaccagaaccggaaucuguccccuuucaugcgcggggcccauaacauaucauuugugacgccacccaguagccgauccucuagccagggaacugucucaacagugccuaaggagguucuggauaguuggaccggcgcuuucaauacuagaaggcaaccacucuuugcccacauccggacacguggugaaucccgcguguga

SEQ ID NO: 22013 - RNA, 807 nt, Artificial Sequence; identical to SEQ ID NO: 22009
  derived and/or modified sequence opt3 from capsid_protein_VP2__Norovirus__AGX85932

SEQ ID NO: 22014 - RNA, 807 nt, Artificial Sequence; identical to SEQ ID NO: 22009
  derived and/or modified sequence opt3 from capsid_protein_VP2__Norovirus__AGX85935

SEQ ID NO: 22015 - RNA, 780 nt, Artificial Sequence
  derived and/or modified sequence opt3 from capsid_protein_VP2__Norovirus__AHI59155
auggccagcgcuuuccuggcaggccucgccggggacgugaucaccaacggagucgguucccuuauuaaugcgggcgcuaacgccguuaaucagaagguggaguacgauuuuaacaaacaacugcagauggcaucuuucaagcacgacaaagaaauguugcagucacagguauuagccacaaagcaacugcagcaggagaugaugaauauaagacagggggugcuaacugcuggaggcuuuagucccgcagaugccgcuaggggugccgucaacgcgccuaugacgaaaauccucgacuggaaugggacccgguauugggcaccaaacagcaugaagacaacuuccuacucuggacaauucucgucaagcccggugcauaagagucccgccccuucccagcacaccgcucugccaaaaucucgccuucagaaugauuuugccagcguuuauuccuuccccucaagugugagcucucaguccacacauucaaccgcacugagcgcuggcacuggcaguucucgauccauuagcccuucgacagccaccccaacguugucucguacuuccgacugggucagagggcaaaacgaaaggcucucacccuuuauggauggagcgcugcagaccgccuucgugacaccuccaaguagcaaggcauccucuaaugguacuguaagcaccguuccgaaagcugugcuggacucauggacacccauguuuaacacccaccggcagccucucuucgcccauccacgcagaaggggcgagagucaagucuga

SEQ ID NO: 22016 - RNA, 807 nt, Artificial Sequence
  derived and/or modified sequence opt3 from capsid_protein_VP2__Norovirus__AHI59158
auggccggcgcuuucuuugcagggcuggccagcgacgugcucggauccggucuuggcucucugaucaacgcgggggcuggagccauuaaucagaaggucgaguucgaaaacaauagaaaauugcaacaggcaucauuucaguucaguagcaacuuacagcaagccuccuuucagcacgauaaggagaugcugcaggcucagauagaagcaaccaaaaagcuacaacaggagaugaugaggguuaaacaggccaugcuccuggaaggcgguuucucugagacagacgcugcccgcggggcgaucaaugcacccaugacuaagacgcuugauuggucgggaacccgguacugggccccugacgcucgaacaacuaccuauaacgccggccguuuuucaacaccacagccgagcggcgcacugcccgggagagcuaauuugagggccaccgugccugcgcggggaaguuccaacacuucuagcuccucaaguauugccacaagcguauacucuaaucaaaccacguccacucgccucgguucaaccgcaggcagcgggacaagugugucuucccugccaagcacugcuagaaccaggucgugggucgaggaucagaaccggaaucugucucccuucaugcgcggagcccauaacaucuccuuugugacaccuccaucaagucgaagcuccucucagggcaccguuagcacggugcccaaggaaguccucgacucauggacuggugcuuucaauacaagaaggcaaccuuuauuugcccacauucggaaacguggggagagucgcguguga

SEQ ID NO: 22017 - RNA, 780 nt, Artificial Sequence
  derived and/or modified sequence opt3 from capsid_protein_VP2__Norovirus__AHI59160
auggccggcgcuuucguggcagggcuggccggagacguccucagcaacggucuuuccucucugaucaaugcgggcgcuaacgccauuaaucagagagcagaguuugauuucaaccaaaaguugcagcaaaauucauuuaaccacgacaaagaaauguuacaggcccagauacaggcuaccaagcagcugcaggcagauaugauggccaucaaacaagggguucuaacagcuggaggcuucagucccgccgacgcggcaaggggugccgugaaugcuccuaugacucaggcccucgauuggaacgggacgcgguacugggcaccaggaagcaugcgcaccacauccuauucuggcaaguuuacuucgaccgcuccgguacgacaggccgacuuccagcauacacaaucacgucccagcaguggcuccucugugagcuccuuugcgacccagucaaguagaccuacucugacaaccacgacugggagcucucacggaaccgccuccucaaauagcacaaggaguacuucucuuucccagagcaccgucucgcgggcaacaucucgcaccuccgagugggugagagaucaaaacaggaaucuggaaccauacaugcauggugcuuugcagacggccuucguuacucccccuucaagucgggcuagcgacggcacaguguccaccgucccaaaaggggugcucgauucuuggacucccgccuuuaacacacgccgacagccucuguucgcacaccugagaaagaggggagagagccaugccuga

SEQ ID NO: 22018 - RNA, 807 nt, Artificial Sequence
  derived and/or modified sequence opt3 from capsid_protein_VP2__Norovirus__AHI59163
auggccggcgcuuucuuugcagggcuggccagcgacgugcucggauccggucuuggcucucugaucaacgcgggggcuggagccauuaaucagaaggucgaguucgaaaacaauagaaaauugcaacaggcaucauuucaguucaguagcaacuuacagcaagccuccuuucagcacgauaaggagaugcugcaggcucagauagaagcaaccaaaaagcuacaacaggagaugaugaggguuaaacaggccaugcuccuggaaggcgguuucucugagacagacgcugcccgcggggcgaucaaugcacccaugacuaagacgcuugauuggucgggaacccgguacugggccccugacgcucgaauuacaacuuauaacgccggccguuuuccaaccccgcagcugucaggcgcauugcccgggagagcuaaucucagggccacagugccugcgcggggaagcccaaguaccuccucuaacagcuccaucgccacuucaguauacaguaaucaaacaaccagcacgcgccuggguucuacugcaggcuccgggaccucagugagcagucugcccucuacagcuagaacuagguccugggucgaggaucagaaccggaaucucagcccuuucuuacgcggagcccauaacauuucguuugugaccccacccucuucccgaucaaguagccagggcacaguuuccaccgugccuaaggaaguccuggacucuuggacgggugcuuucaauacuagaaggcaaccacuuuuugcccacauccggaaacguggggagagccgcguguga

SEQ ID NO: 22019 - RNA, 807 nt, Artificial Sequence
  derived and/or modified sequence opt3 from capsid_protein_VP2__Norovirus__AHI59166
auggccggcgcuuucuuugcagggcuggccagcgacgugcucggauccggucuuggcucucugaucaacgcgggggcuggagccauuaaucagaaggucgaguucgaaaacaauagaaaauugcaacaggcaucauuucaguucaguagcaacuuacagcaagccuccuuucagcacgauaaggagaugcugcaggcucagauagaagcaaccaaaaagcuacaacagggcaugaugaaaguuaagcaggccaugcuccuggaggguggguucucugaaacagacgcugccaggggagcgaucaaugcacccaugacuaaggcccuugauuggucgggcacgcgguacugggcuccugacgcccgcaccacaacuuauaacgcaggccgauuuucaaccccacagccgagcggggcucugcccggacguaauaacuugagagccacagugccugcgagggguaguuccucuacccucagcuccauuccaacugccacaucaguauacaguaaucaaaccgugagcacgcggcuggggucuuccgcaggcucaggaacuagcgucaguucucugcccuccaccgcucgcacaagaagcuggguggaggaucagaacaaaaaucucucgccuuucaugaggggcgccuuaaacacuucuuuuguuaccccacccuccucacggaguagcucccaggguacagugucuaccgucccuaaggagauccuggacagcuggacgggggcuuucaauacucgccgacaaccacuuuuugcccaugugagaaaaaggggagaaucacggguauga

SEQ ID NO: 22020 - RNA, 807 nt, Artificial Sequence
  derived and/or modified sequence opt3 from capsid_protein_VP2__Norovirus__AHX22026
auggccggcgcuuucuuugcagggcuggccagcgacgugcucggauccggucuuggcucucugaucaacgcgggggcuggagccauuaaucagaaggucgaguucgaaaacaauagaaaauugcaacaggcaucauuucaguucaguagcaacuuacagcaagccuccuuucagcacgauaaggagaugcugcaggcucagauagaagcaaccaaaaagcuacaacaggagaugaugaggguuaaacaggugaugcuccuggaaggcgguuucucugagacagacgccgcucgcggggccaucaaugcgcccaugacuaaggcacuugauuggucgggaacgcgguacugggccccugacgcucgaaccacaacuuauaacgccggccguuuuucaaccccacagccgagcggcgcacugcccgggagagcuaauuugaggguaacagccccugcgcggggaaguuccucuaccagcuccaacucaaguauugccacuagcguguacucuucccaaacaaccucaacgcgccucgguagcacugcaggcagugggaccucugucuccagccugccaucgacagcuagaacuaggucuuggguggaggaucagaaucggaaccugucccccuucaugcgcggagcccauaauaucucauuuguuaccccuccaaguagccgauccucuagccagggcacagugucaaccguccccaaggaagugcucgacaguuggacgggugcuuucaacacuagaaggcaaccuuuauuugcccacauucggaaacguggggagucccgcguauga

SEQ ID NO: 22021 - RNA, 807 nt, Artificial Sequence
  derived and/or modified sequence opt3 from capsid_protein_VP2__Norovirus__AHX22029
auggccggcgcuuucuuugcagggcuggccagcgacgugcucggauccggucuuggcucucugaucaacgcgggggcuggagccauuaaucagaaggucgaguucgaaaacaauagaaaauugcaacaggcaucauuucaguucaguagcaacuuacagcaagccuccuuucagcacgauaaggagaugcugcaggcucagauagaagcaaccaaaaagcuacaacaggagaugaugaaaguuaaacaggugaugcuccuggaaggcgguuucucugagacagacgccgcuaggggagccaucaaugcgcccaugacuaaggcacuugauuggucggggacgcgguacugggccccugacgcucgcaccacaacuuauaacgccggccgauuuucaaccccacagccgagcggcguacugcccgggcgugcaaauuugagagaugcugugccugccaggggaaguuccucuaagagcuccaacucauucacagcgaccagugucuacagcaaucaaacuacaucuacccggcucgguuccacggccggcucagggacuagcgugaguucucugccauccaccgcacgcacaagaagcuggguugaggaccagucgaggaacgugucucccuuuaugcggggagcucauaauauuuccuucgucacuccuccaucaagucgcagcuccucucagggcaccgugagcacaguacccaaggaaguucuggauucauggaccggugccuuuaacacgcgaagacaaccucucuucgcucacaucaggaaacguggggagagucggguguga

SEQ ID NO: 22022 - RNA, 807 nt, Artificial Sequence
  derived and/or modified sequence opt3 from capsid_protein_VP2__Norovirus__AHX22033
auggccggcgcuuucuuugcagggcuggccagcgacgugcucggauccggucuuggcucucugaucaacgcgggggcuggagccauuaaucagaaggucgaguucgaaaacaauagaaaauugcaacaggcaucauuucaguucaguagcaacuuacagcaagccuccuuucagcacgauaaggagaugcugcaggcucagauagaagcaaccaaaaagcuacaacaggagaugaugaggguuaaacaggugaugcuccuggaaggcgguuucucugagacagacgccgcucgcggggccaucaaugcgcccaugacuaaggcacuugauuggucgggaacgcgguacugggccccugacgcucgaaccacaacuuauaacgccggccguuuuucaaccccacagccgagcggcgcacugagugggagagcuaauuugagggccacagcgcccgcccggggauccucuagcaccuccucaaacaguagcauugcaacuucuguauacuccaaucaaacaaccucaacgcgccucgguagcacugcuggcagugggaccucuguguccagcccuccaucgacagccagaacuaggucuugggucgaggaucagaaccggaaucugucccccuucaugcgcggagcucauaacaucucauuugugaccccuccaaguagccgauccucuagccagggcacaguuucaaccgugcccaaggaaguccuggacaguuggacgggugccuucaauacuagaaggcaaccucucuuugcacacauucggaaacguggggagucccgcguguga

SEQ ID NO: 22023 - RNA, 807 nt, Artificial Sequence
  derived and/or modified sequence opt3 from capsid_protein_VP2__Norovirus__AHX22036
auggccggcgcuuucuuugcagggcuggccagcgacgugcucggauccggucuuggcucucugaucaacgcgggggcuggagccauuaaucagaaggucgaguucgaaaacaauagaaaauugcaacaggcaucauuucaguucaguagcaacuuacagcaagccuccuuucagcacgauaaggagaugcugcaggcucagauagaagcaaccaaaaagcuacaacaggagaugaugaggguuaaacaggccaugcuccuggaaggcgguuucucugagacagacgcugcccgcggggcgaucaaugcacccaugacuaagacgcuugauuggucgggaacccgguacugggccccugacgcucgaacaacuaccuauaacgccggccguuuuucaacaccacagccgagcggcgcacugcccgggagagcuaguuugagggccaccgugccugcgcggggauccucuagcauguccucaaauaguagcauugccacuucuguauacuccaaccaaacaaccucaacgcgccucgguagcacugcaggcagugggaccucuguguccagccugccaucgacagcuagaacuaggucuugggucgaggaucagaaucggaaccugucccccuucaugcgcggagcccauaauaucucauuugugaccccuccaaguagcauuuccucuagccagggcacaguuucaaccgugcccaaggaaguccucgacaguuggacgggugcuuucaacacucgaagacaaccuuuauuugcccacaucaggaaacguggggagucccggguguga

SEQ ID NO: 22024 - RNA, 807 nt, Artificial Sequence
  derived and/or modified sequence opt3 from capsid_protein_VP2__Norovirus__AHX22039
auggccggcgcuuucuuugcagggcuggccagcgacgugcucggauccggucuuggcucucugaucaacgcgggggcuggagccauuaaucagaaggucgaguucgaaaacaauagaaaauugcaacaggcaucauuucaguucaguagcaacuuacagcaagccuccuuucagcacgauaaggagaugcugcaggcucagauagaagcaaccaaaaagcuacaacaggagaugaugaaaguuaagcaggccaugcuccuggaaggcgguuucucugagacagacgcugccaggggagcgaucaaugcacccaugacuaaggcccuugauuggucggggacgcgguacugggcuccugacgcccgcaccacaacuuauaacgcaggccgauuuucaaccccacagccgagcggcgcucugcccgggcgugccaauuugagagaugcggugccugccaggggaaguuccucuaaaagcuccaacucaaguacagcaaccagcguauacucuaaucaaacuacauccacccggcucgguucaacggcuggcagcgggaccagugugucuucccugccaagcacugcccgcacaagaucgugggucgaggaccagucuaggaaccugucccccuucaugcggggagcucauaauauuucauuugugacuccuccaaguagccgcuccucuagccagggcaccguuucaacagugcccaaggaaguccucgauaguuggaccggugccuucaacacgcgaagacaaccuuuauuugcacacaucaggaaacguggggagucccggguguga

SEQ ID NO: 22025 - RNA, 807 nt, Artificial Sequence
  derived and/or modified sequence opt3 from capsid_protein_VP2__Norovirus__AHX22042
auggccggcgcuuucuuugcagggcuggccagcgacgugcucggauccggucuuggcucucugaucaacgcgggggcuggagccauuaaucagaaggucgaguucgaaaacaauagaaaauugcaacaggcaucauuucaguucaguagcaacuuacagcaagccuccuuucagcacgauaaggagaugcugcaggcucagauagaagcaaccaaaaagcuacaacaggagaugaugaaaguuaagcaggccaugcuccuggaaggcgguuucucugagacagacgcugccaggggagcgaucaaugcacccaugacuaaggcccuugauuggucggggacgcgguacugggcuccugacgcccgcaccacaacuuauaacgcaggccgauuuucaaccccacagccgagcggcgugcugcccgggcgugcuaauuugagagaugccguaccugcgaggggaaguuccucuaaaagcuccaacucauucacagccaccaguguguacagcaaucaaacuacaucuacccggcucgguuccacggcaggcucagggacuagcgucaguucucugccauccaccgcucgcacaagaagcuggguggaggaccagucgaggaaccugucucccuuuaugcggggagcccauaauauuuccuucguuacuccuccaucaagucgcagcuccucucagggcaccgugagcacaguccccaaggaagugcucgauucauggaccggugcuuuuaacacgcgaagacaaccuuuauucgcccacaucaggaaacguggggagagucggguauga

SEQ ID NO: 22026 - RNA, 807 nt, Artificial Sequence
  derived and/or modified sequence opt3 from capsid_protein_VP2__Norovirus__AHX22048
auggccggcgcuuucuuugcagggcuggccagcgacgugcucggauccggucuuucuucacugaucaacgcgggcgcuggggccauuaaucagaaggucgaguucgaaaacaauagaaaauugcaacaggcaaguuuucaguucagcuccaacuuacagcaagccucuuuucagcacgauaaggagaugcugcaggcucagauagaagcaaccaaaaagcuacaacaggagaugaugaggguuaaacaggccaugcuccuggaaggaggcuucucggagacagacgcugcccggggugcgaucaaugcacccaugacuaaggcccuugauuggucagggacgcgcuacugggcuccugacgcccgaaccacaacuuauaacgcaggacguuuuagcaccccacagccgaguggcgcucugcccggcagagccaauuugagggcggccgugccugcacggggguccucuagcauguccucaaacaguagcacagcuaccucuguauacuccaaucaaacuacaucaacccgccucggaagcacggccgguaguggcacuucuguguccagccugccaucgaccgcuagaauuaggucuugggucgaggaucagaaccggaaucugucccccuucaugcgcggggcccauaacaucucauuugugacaccuccaaguagccgauccucuagccagggaacuguuucaaccgugcccaaggaaguccucgacaguuggacaggcgcauucaauaccagaaggcaaccuuuauuugcccacauucggaaacguggugagucccgcgcuuga

SEQ ID NO: 22027 - RNA, 807 nt, Artificial Sequence; identical to SEQ ID NO: 22023
  derived and/or modified sequence opt3 from capsid_protein_VP2__Norovirus__AHX22051

SEQ ID NO: 22028 - RNA, 807 nt, Artificial Sequence
  derived and/or modified sequence opt3 from capsid_protein_VP2__Norovirus__AHX22055
auggccggcgcuuucuuugcagggcuggccagcgacgugcucggauccggucuuucuucacugaucaacgcgggcgcuggggccauuaaucagaaggucgaguacgaaaacaauagaaaauugcaacaggcaaguuuccaguuuagcuccaacuuacagcaagccucuuuccagcacgauaaggagaugcugcaggcucagauagaagcaaccaaaaagcuacaacaggagaugaugaggguuaaacaggccaugcuccuggaaggaggcuuuucggagacagacgcugcccggggugcgaucaaugcacccaugacuaagacgcuugauuggucagggacccgcuauugggccccugacgcucgaacaacuaccuacaacgccggacguuucagcacaccacagccgaguggcgcacugcccggcagagcuaauuugagggccaccgugccugcgcggggguccucuagcacuuccucaaacaguagcauugccacaucuguauauuccaaucaaaccacgcucacucgccugggaucaaccgcagguagcggcacaagugugucuucccugccaagcacugcuagaaccaggucgugggucgaggaucagaaccggaaucucucucccuuuaugcgcggggcccauaacaucuccuucgugacaccuccaucaagucgaagcuccucucagggaaccguuagcacggugcccaaggaagucuuagacucauggacuggcgcuuuuaauacaagaaggcaaccucuguucgcccacauucggaaacguggugagagucgcguguga

SEQ ID NO: 22029 - RNA, 693 nt, Artificial Sequence
  derived and/or modified sequence opt3 from capsid_protein_VP2__Norovirus__AII02849
auggccggcgcuuucaucgcagggcuggccggagacaugcucaccaacacaguggguagccuugucaaugcgggcgcuaacgccauuaaucagacuauagauuuugagaacaauaaguaccugcaaaacgcauccuucaaucacgacaaagaaauguugaacgcccagaucgaggcuacgaagagauuacaggcagauaugauugccaucaaacaggggguucugaccgcuggaggcuuuucucccacagacgccgcgaggggugcaauuaaugccccuaugacuaaggugcuagauuggaacgggacccgguauugggcuccaggagccacaucaaccacaaguaugagcggcggcuucaucaaucaaacuguacaucgcuccaccccgaacuuuaaaacgaaucaggcacccaagccugcuccaucuucggggucaagcgugcgaaguaacuccacucagauaaccucucucagcucccacucaaguggaagcucucguuccucagguagcacagucgugaguucuauccccuccagcaauagaacuagggacuggguuaaccagcaaaacuucaaucuggaaccucauaugccaggcucgcuucggaccgccuuugugacacccccuucuuccaccgcgucaaguagcgggacggucuccacugugccaaagaacguacuggauucuuga

SEQ ID NO: 22030 - RNA, 804 nt, Artificial Sequence
  derived and/or modified sequence opt3 from capsid_protein_VP2__Norovirus__AKE07101
auggccggggcuuucuuugcagggcuggccagcgacgugcucggauccggucuuggcucucugaucaacgcgggggcuggagccauuaaucagaaggucgaguucgaaaacaauagaaaauugcaacaggcaucauuucaguucaguagcaacuuacagcaagccuccuuucagcacgauaaggagaugcugcaggcucagauagaagcaaccaaaaagcuacaacaggagaugaugaaaguuaagcaggccgugcuccuggaaggcgguuucucugagacagacgcugccaggggagcgaucaaugcacccaugacuaaggcccuugauuggucggggacgcgguacugggcuccugacgcccgcaccacaacuuauaacgcaggccauuuuucaaccccacagccgagcggcgcuccccuggggcgagccaauuugcgugcggccguaccuacaagaggaaguuccucuaccagcuccaacucaaguauugcaacuagcguguacucuaaucaaacagcuuccaccaggcucgguucaacggccggcagcggggcuagugucucuucccugccaagcacugcccggacccgcucguggguggaggaucagagaaaccugucucccuucaugaggggagcacacaauaucuccuuuguuacaccuccaucaagucggagcuccucucagggcacugugagcaccguccccaaagaagugcucgacucauggacaggugccuucaacacccgccgacaaccuuuauuugcucauauuagaaagaggggcgagagucggguauga

SEQ ID NO: 22031 - RNA, 807 nt, Artificial Sequence
  derived and/or modified sequence opt3 from capsid_protein_VP2__Norovirus__AKE07104
auggccggcgcuuucuuugcagggcuggccagcgacgugcucggauccggucuuggcucucugaucaacgcgggggcuggagccauuaaucagaaggucgaguucgaaaacaauagaaaauugcaacaggcaucauuucaguucaguagcaacuuacagcaagccuccuuucagcacgauaaggagaugcugcaggcucagauagaagcaaccaaaaagcuacaacaggagaugaugaaaguuaagcaggccgugcuccuggaaggcgguuucucugagacagacgcugccaggggagcgaucaaugcacccaugacuaaggcccuugauuggucggggacgcgguacugggcuccugacgcccgcaccacaacuuauaacgcaggccgauuuucaaccccacagccgagcggcauucugcccgggcgugcuaauuugagagauacaguaccugccaggggaaguuccucuaccagcuccaaaucaaguaucgcgacuagccucuacucuaaccaaacagccaccacgcggcuggguuccacugcaggcucagggaccagcgugaguucucugccauccacagcucgcacuagaagcugggucgaggaccagaauaggaaccucucgcccuucaugcggggagcccauaauauuucuuuugugaccccuccauccucacgcaguagcucccagggcacaguuucuaccgugcccaaggaagucuuagauagcuggacgggugcuuucaacacucgaagacaaccucuguuugcccacaucaggaaacguggggagucacggguguga

SEQ ID NO: 22032 - RNA, 807 nt, Artificial Sequence
  derived and/or modified sequence opt3 from capsid_protein_VP2__Norovirus__AKE07107
auggccggcgcuuucuuugcagggcuggccagcgacgugcucggauccggucuuggcucucugaucaacgcgggggcuggagccauuaaucagaaggucgaguucgaaaacaauagaaaauugcaacaggcaucauuucaguucaguagcaacuuacagcaagccuccuuucagcacgauaaggacaugcugcaggcucagauagaggcaaccaaaaagcuacaacaggaaaugaugaggguuaaacaggccaugcuccuggagggcgguuucucugaaacagaugcugcccgcggggcgaucaaugcacccaugacuaaggcccuugacuggucgggaacgcgguacugggcuccugaugcccgaaccacaacuuauaacgcaggccauuuuucaaccccacagccgagcggcgcucugcccgggcgugccaauuugagagcggccgugccugcaaggggaccaaguuccacaucuagcaacuccucaaccgcuacaaguguauacagcaaucaaacuaccucuacgcggcucgguuccacugccggcucaggggcuagcgugaguucucugcccuccaccgcccgcacagucaacugggugagagaccagaauaggagccugucgccuuucaugcggggagcacacaacacuucuuuuguuaccccacccuccucacgcaguagcucccagggcacagugucuaccgucccuaaggaggugcucgauagcuggacgggugccuucaauacucgaagacaaccauuauuugcucauauuaggacacguggggagucacggguauga

SEQ ID NO: 22033 - RNA, 765 nt, Artificial Sequence
  derived and/or modified sequence opt3 from capsid_protein_VP2__Norovirus__ALE30634
auggccggcgcuuucaucgcagggcuggccggagacaugcucaccaacacaguggguagccuugucaaugcgggcgcuggggccauuaaccagaagguugauuuugagaauaacaaauaccugcaaaaugcauccuucaaccacgacaaggaaauguugaaugcccagauagaggcuacuaaaagauuacaggcagauaugaucgccauuaagcagggagugcugacggcuggcgguuuuucucccaccgacgccgcgaggggagcaaucaacgccccuauuacaaaaguacuagauuggucagggacucgguauugggcuccaaaugccaccaguacaaccagcauguccggcggcuucacugggcaagcagugcaucgcgcuacaccgaacuuuaagaccaaucaggcccccaagucuacgccuucgucaggaagcaguguccgauccucuagcacucagcucaccaaccuguccucacacaguagcgguucuucccguucaagcggcaguacaauggugucuucccuuccaagcucgucuagaacuagggacuggguuaaucagcaaaacuucaaucuggaaccccauaugccuggguccuugcggaccgcguuugugacaccacccucaaguaccgccagcucccucgauacggucucuacugugccuaaaagcguacuggacucauggacaccagcauucaacacccgcagacagccgcuguuugcucaccucaggcggcgcggagagaguaacaucuga

SEQ ID NO: 22034 - RNA, 765 nt, Artificial Sequence
  derived and/or modified sequence opt3 from capsid_protein_VP2__Norovirus__ALE30636
auggccggcgcuuucaucgcagggcuggccggagacaugcucaccaacacaguggguagccuugucaaugcgggcgcuggggccauuaaccagaagguugauuuugagaauaacaaauaccugcaaaaugcauccuucaaccacgacaaggaaauguugaaugcccagauagaggcuacuaaaagauuacaggcagauaugaucgccauuaagcagggagugcugacggcuggcgguuuuucucccaccgacgccgcgaggggagcaaucaacgccccuauuacaaaaguacuagauuggucagggacucgguauugggcuccaaaugccaccaguacaaccagcauguccggcggcuucacugggcaagcagugcaucgcgcuacaccgaacuuuaagaccaaucaggcccccaagucuacgccuucgucaggaagcaguguccgauccucuagcacucagcucaccaaccuguccucacacaguagcgguucuucccguucaagcggcaguacaauggugucuucccuuccaagcucgucuagaacuagggacuggguuaaucagcaaaacuucaaucuggaaccccauaugccuggguccuugcggaccgcguuugugacaccacccucaaguaccgccagcucccucgauacggucucuacugugccuaaaagcguacuggacucauggacaagugcauucaacacccaccgccagccacuguuugcucaucucagaaagaggggagaguccaacguuuga

SEQ ID NO: 22035 - RNA, 780 nt, Artificial Sequence
  derived and/or modified sequence opt3 from capsid_protein_VP2__Norovirus__BAR42290
auggccggcgcuuucaucgcagggcuggccggagacaugcucaccagcuccguggguucucuugucaacgcgggcgcuaaugccauuaaccagaagauagauuuugagaauaacaaacaacugcagucagcaaguuuccagcacgacaaggaaauguugcaggcccaaguuagagcuacaaaacaguuacagagcgagaugaucgcacugaagcagggggugcuagccgcuggaggcuuuucccccacugaugccgcgagggguucuauuggggcaccuaugacgaaaguacucgacuggucgggaacccgguacugggccccaaauucaacaaagacuaccggcuauagcggccaauucacaaguuccccggugcauaugucuagccccaacgcuccucaguccaagccagccaaaccccgcucacuggcaccuaguucuagcuccucaagcgucuacaguauguauacccagucuacucaccuuacauccgggagcucgucuaaugcuuccucagccaguaccaagcugacgagcuuguccucuggaagcucacagaaccgaacugcggaaugggugaaucaacagcguagucucuccccauuuaugagcggugcccugaacaucucucauguuacacccccuucaaguagagcaagcuccucuggcaccgugucgacugucccaaaagaggugcuggauagcuggaccuccgcuuucaauacacacaggcagccgcucuuugcccauuuacggguacgcggggaaucaagaguuuga

SEQ ID NO: 22036 - RNA, 780 nt, Artificial Sequence
  derived and/or modified sequence opt3 from capsid_protein_VP2__Norovirus__BAR47617
auggccggcgcuuucaucgcagggcuggccggagacaugcucaccagcuccguggguucucuugucaacgcgggcgcuaaugccauuaaccagaagauagauuuugagaauaacaaacaacugcagucagcaaguuuccagcacgacaaggaaauguugcaggcccaaguuaaagcuacaaagcaguuacagagcgagaugaucgcacugaaacagggggugcuagccgcuggaggcuuuucccccacugaugccgcgagaggugcaauuggggccccuaugacgaagguacucgacuggucuggaaccagguacugggcuccaaauucgacaaagacuaccggcuauucaggccaauucacaagcaguccggugcauaugcccuccccuaacgccccacagucuaaacccgcaaagccucggagccuggcuccauccucaaguucuagcuccgucuacucaaugagcacccagaguacucaccuuacaucuggguccagcucgaaugccucuuccgcgucaaccaaacugacgaacuugaguagcggauccucucagaaucgcacugccgaaugggugaaccaacagcgaagccucucacccuuuaugaguggugcacugaauaucucccauguuaccccuccaagcucucgugcuucaaguagcggcacaguguccacugucccgaaggaggugcuggauucuuggaccucggccuucaacacacacagacagccccucuuugcucauuuaaggguacgcggggaaagccggguuuga

SEQ ID NO: 22037 - RNA, 780 nt, Artificial Sequence
  derived and/or modified sequence opt3 from capsid_protein_VP2__Norovirus__BAR63716
auggccggcgcuuucaucgcagggcuggccggagacaugcucaccagcuccguggguucucuugucaacgcgggcgcuaaugccauuaaccagaagauagauuuugagaauaacaaacaacugcagucagcaaguuuccagcacgacaaggaaauguugcaggcccaaguuaaagcuacaaagcaguuacagagcgagaugaucgcacugaaacagggggugcuagccgcuggaggcuuuucccccacugaugccgcgagaggugcaauuggggccccuaugacgaagguacucgacuggucuggaaccagguacugggcuccaaauucgacaaagacuaccggcuauucaggccaauucacaagcaguccggugcggaugcccuccccuaacgccccacagucuaaacccgcaaagccucgcagccuggcuccauccucaaguucuagcuccgucuacucaaugagcacccagaguacucaucuuacaucuggguccagcucgaaugccucuuccgcgucaaccaaacugacgaacuugaguagcggauccucucagaaucgaacugccgaaugggugaaccaacagcguagccucucacccuuuaugaguggugcacugaauaucucccacguuaccccuccaagcucuagagcuucaaguagcggcacaguguccacugucccgaaggaggugcuggauucuuggaccucggccuucaacacacauaggcagccccucuuugcucacuuacggguacgcggggaaagcagaguuuga

SEQ ID NO: 22038 - RNA, 780 nt, Artificial Sequence; identical to SEQ ID NO: 22036
  derived and/or modified sequence opt3 from capsid_protein_VP2__Norovirus__BAR63719

SEQ ID NO: 22039 - RNA, 780 nt, Artificial Sequence; identical to SEQ ID NO: 22036
  derived and/or modified sequence opt3 from capsid_protein_VP2__Norovirus__BAR63722

SEQ ID NO: 22040 - RNA, 807 nt, Artificial Sequence
  derived and/or modified sequence opt3 from capsid_protein_VP2__Norovirus__BAS02084
auggccggcgcuuucuuugcagggcuggccagcgacgugcucggauccggucuuggcucucugaucaacgcgggggcuggagccauuaaucagaaggucgaguucgaaaacaauagaaaauugcaacaggcaucauuucaguucaguagcaacuuacagcaagccuccuuucagcacgauaaggagaugcugcaggcucagauagaagcaaccaaaaggcuacaacaggagaugaugaagguuaaacaggccaugcuccuggaaggcgguuucucugagacagacgcugcccgcggggcgaucaaugcacccaugacuaaggcccuugauuggaacggaacgcgguacugggcuccugacgcccgaaccacaacuuauaaugcaggccguuuuucgaccccacagccgucaggcgcucugcccgggagagccaacuugagggaugcggugccugcccggggaagcaguuccaagucuagcaauuccucaacagcaaccaguguauacagcaaccaaacuauuucuacacgccucgguuccaccgcuggcucagggacgagcgugaguucuuucccauccacugccagaaccaggagcugggucgaggaccagucgcggaaucugucucccuuuaugcgcggagcucauaacaucuccuucgugacaccuccaucaagucgaagcuccucucagggcacuguuagcaccgugcccagagaaauucuggauucauggacaggugccuuuaauaccaggcggcaaccucucuucgcacacauccguaaacgcggggagaguagagucuga

SEQ ID NO: 22041 - RNA, 627 nt, Artificial Sequence
  derived and/or modified sequence opt3 from capsid_protein_VP2__Norovirus__CRL46953
auggcccaggcuaucauuggcgcaauagccgcgagcgcugccggguccgcacugggagccgguauccaagcuggcgcagaggccgcucuccaggcccagagauaccagcaagaccuuacccugcagcagaacucuuucaaucacgauaaggaaauguugggguaucagguggagaugucaaacaaauuacuggcgaagaaucuaaacacaagguacagucuccugcaagcaggaggccuuagccccuccgacgccgcucgggccgucgcaggggcuccuguuacucgccugguggauugggguggaguacgaguggccgcgccacagucuucggccacgaccuugcguucaggcaauuuuauggcagucccgcuccccgcucagccuaaacagaagccacuggccagcgaaggcuauaguaaccccgcuuacgacccuaugcaaagaacagccuccugggugcagucucagaauagcuccaggaacuggucaccauaucaucggcaagcacugcagacuguuugggugacacccccugggaguaccucuagcuccucagucagcaccgccccacgcggauacuucaauacugauagacucccguuauuugcuaaccugaggcgguga

SEQ ID NO: 22042 - RNA, 630 nt, Artificial Sequence
  derived and/or modified sequence opt3 from capsid_protein_VP2__Norovirus__CRL46956
auggcccaggcugugaucggcgcaauugccgcgagcgcugccggguccauacugggagcagguauccaagccggcgcugaggcagggcuccaggcccagagauaccagcaagaccuucagcugcagcagaacucuuucaagcacgauaaagaaauguugggauaucaaguccaggcuucaaaugccuuacuggcgaagaaccuaaauaccagguacgcacuccugcaggccggcggucuuaguagcgcugacgccgcacgggcuguugccggggcgcccgugacacgcauuguagauuggaacggaacucgaaucgccgcuccugcauccucugccacgacccugcguucgggcggcuuuauggcugugccaauuccguugucaagcaaaacaaagcagcccgucaugagugggcaagacaauccuaacuaugccgcauccucuaucagcagaacugccuccugggugcagucacagaauaguaugaggagcguuucuccauuccauuccgaugcucuccggaccgugugggucacacccccuggaucaagcaguaccucuuccgugcaaagcucguuuuacgguguauucaacacugaccgccugccacuguuugcgaauagaagguga

SEQ ID NO: 22043 - RNA, 807 nt, Artificial Sequence
  derived and/or modified sequence opt3 from capsid_protein_VP2__Norovirus__CRL46959
auggccggcgcuuucuuugcagggcuggccagcgacgugcucggauccggucuuucuucacugaucaacgcgggcgcuggggccauuaaucagaagauagauuucgagaacaauagaaaauugcaacaggcaaguuuucaguucagcuccaacuuacagcaagccucuuuucagcacgacaaggaaaugcugcaggcucaggucgaggcaaccaaaaagcuacaacaggaaaugaugaaaguuaagcaggccauccuccuggagggaggcuucucggcuacagaugccgcgaggggugcaauuaaugcccccaugacuaaggugcuugacuggaacgggacgcgguacugggcuccugaugcccgcaccacaacuuauaauaccggacauuuuucaacaccacagagcaguggcgcacugccgggccgaaccaacccccguaucccuacuccagcuagagccuccucuagcacauccucaaaugcgaguaccgccacgagcauuucuuccaaccaaacuguaucaaccagguuggggagcacagcaggaagugguacuaaugugucuucccuccccagcaccgcucggacacgcucgugggucgaagaccagaacagaaaucugucuccuuucaugaggggcgcccacaacaucuccuuugugaccccacccucaagucggagcuccucucaggggacgguuagcacugugccuaaaggaguccuggauucauggacaggcgcuuucaauacccgccgacaaccacucuuugccuacacucauagaaggggugagagucggguguga

SEQ ID NO: 22044 - RNA, 807 nt, Artificial Sequence
  derived and/or modified sequence opt3 from capsid_protein_VP2__Norovirus__CRL46962
auggccggcgcuuucuuugcagggcuggccagcgacgugcucggauccggucuuggcucucugaucaacgcgggggcuggagccauuaaucagaaggucgaguucgaaaacaauagaaaauugcaacaggcaucauuucaguucaguagcaacuuacagcaagccuccuuucagcacgauaaggagaugcugcaggcucagauagaagcaaccaaaaagcuacaacaggagaugaugaaaguuaagcaggccaugcuccuggaaggcgguuucucugagacagacgcugccaggggagcgaucaaugcacccaugacuaaggcccuugauuggucggggacgcgguacugggcuccugacgcccgcaccacaacuuauaacgcaggccgauuuucaaccccacagccgagcggcgcucugcccgggcgugccaauuugagagaugcggugccugccaggggaccaaguuccaaauucucuaacagcuccacagcaaccucaguauacaguaaucaaacuauuagcacacggcucgguucuaccgcuggcuccgggacgucagugagcagucugcccucuacugcccgcaccagauccugggucgaggaccagagcaggaaccugucgccuuuuaugggaggcgcucauaauaucucuuucgugacaccacccuccucacggaguagcucccaggguacuguuucuaccgugccuaaggaaauucucgauagcuggacaggggccuuuaacacccgccgacaaccauuauucgcacacaucagaaaaaggggagagucacgggucuga

SEQ ID NO: 22045 - RNA, 807 nt, Artificial Sequence
  derived and/or modified sequence opt3 from capsid_protein_VP2__Norovirus__CRL46965
auggccggcgcuuucuuugcagggcuggccagcgacgugcucggauccggucuuggcucucugaucaacgcgggggcuggagccauuaaucagaaggucgaguucgaaaacaauagaaaauugcaacaggcaucauuucaguucaguagcaacuuacagcaagccuccuuucagcacgauaaggagaugcugcaggcucagauagaagcaaccaaaaagcuacaacaggagaugaugaaaguuaagcaggccgugcuccuggaaggcgguuucucugagacagacgcugccaggggagcgaucaaugcacccaugacuaaggcccuugauuggucggggacgcgguacugggcuccugacgcccgcaccacaacuuauaacgcaggccgauuuucaaccccacagccgagcggcgcucugcccgggcgugccaauuugagagaugcggccccugcaaggggaaguuccucuaaaagcuccaacucauucacagcuaccaguguauacagcaaucaaacuacaucuacccggcucgguuccacggccggcucagggacuagcgugaguucucugccauccaccgcucgcacaagaagcugggucgaggaccagucgaggaaccugucucccuuuaugcggggagcccauaauauuuccuucgugacuccuccaucaagucgcagcuccucucagggcaccguuagcacagugcccaaggaaguccucgauucauggaccggugcauuuaacacgcgaagacaaccuuuauucgcccacaucaggcggcguggggagagucgcguguga

SEQ ID NO: 22046 - RNA, 777 nt, Artificial Sequence
  derived and/or modified sequence opt3 from capsid_protein_VP2__Norovirus__CRL46968
auggccggcgcuuuccuggcagggcucgugggagacgccaucaccagcggugucggcucccuuauuaacgcgggggcuaaugccauaaaccagaagguugaguacgauuuuaauaaacaacugcaguuggcaucuuucaagcacgacaaagaaauguuacagucacaggugcuggccacaaagcaacuacagcaggagaugaugaacaucagacagggaguacucagugcuggcgguuuuagccccacugaugcagccaggggagcugugaaugccccuaugacgaaaauucuggacuggaacgggacccgguauuucgcgccaaauuccaugaagacaacuucuuacucgggccaauuuucaagcaacccgguccaucgccagcccaccaguccucgauccgauccacccaagaucaaaguuaauucugacagcgcauccguguauucaagugccagcucugcuccuucccagucaacacacagcaccgcccuuacugcaggcaguucuuccagccguacaaccucgucuuccgcugccgcgucaacgcugaguagaacuagcgauugggugagggggcagaacgaacgguuguccccauucauggacggagcccuccaaaccacauuugucacucccccuucuagcaaggcaucaaguuacgguuccgugagcaccguaccaaaagcuguucuggauucuuggacaccgauguucaauacccaucgccagccccuguuugcccacgugagaaggcggggcgagucacagauuuga

SEQ ID NO: 22047 - RNA, 765 nt, Artificial Sequence
  derived and/or modified sequence opt3 from capsid_protein_VP2__Norovirus__CRL46971
auggccggcgcuuucaucgcagggcuggccggagacaugcucaccaacacaguggguagccuugucaaugcgggcgcuaacgccauuaaucagacuauagaucuggagaacaauaaguacuugcaaaacgcauccuuuaaucacgacaaagaaauguuaaacgcccagaucgaggcuacgaagaaacugcaggcagauaugauugccaucaagcaggggguucuaaccgcuggaggcuucucucccacagacgccgcgagaggugcaauuaaugccccuaugacuaaagugcucgauuggaacgggaccaggcauugggcuccaggagccacaucaaccacaaguaugagcggcggcuuuacucaccaaaccguacaucgguccacgccgaauuucaagacuaaccaggcacccaagucuaccccuucgucagggagcagugugcgcuccaauucuacacagaucacuagccuguccucacacaguagcggaucuucccgaucaagcgguaguaccgucauacguucuaucccauccagcgacagaacaagggauugggugaaccagcaaaauuuuaaccuugaaccccauaugccuggcucgcugcggaccgcuuucguuacgccacccucuuccacugccucaaguagcgggacaguguccaccgucccuaaaaacguguuggacucuuggacuagcgcguuuaauacacgcagacagccacucuucgcccaccugaggcggcgcggagagucaaacguauga

SEQ ID NO: 22048 - RNA, 771 nt, Artificial Sequence
  derived and/or modified sequence opt3 from capsid_protein_VP2__Norovirus__CRL46974
auggccggcgcuuucguggcagggcuggccggagacaucgucaccaacagcauugguucccucguuaaugcgggcgcuaacgccauaaaucagaagguggauuuugagaacaauaaacaacuucagcaggcaucuuucaaccacgaccaggaaaugcugcaagcccagauccaggcuacaaagcaguugcaagcagauaugauugccuuaagacaggggguacugacugcuggaggcuuuucacccacggacgccgcgaggggugcagugaaugccccuaugacccagguccuagauuggagugggacacgguacugggcuccaggagccacuaaaaccacagcauucagcggcggcuuuaccuccucuccgaacacucgcacaaucgugcccaagaaaaccucggcuacgccugccucaacuagcguuagucgaccauccucucucgcgagcaccgccuccacacguucaacuuucgugagugggaccagcucucuguccucaagcacaagaaguucuuuuaauucccagcccaccagcucgucuuccaggacgucagaguggguccggagucaaaaccgcgugcuugaaccuuauaugagaggaagccugcagacugcauucguaacaccacccuccucuagggcuagcucaaaugguaccguuaguacugugccuaaggaggucuuggacuccuggacaagcguguuuaacacccaccggcagccacucuucgcccaucugcgccgaagaggcgaaucucaaguguga

SEQ ID NO: 22049 - RNA, 807 nt, Artificial Sequence
  derived and/or modified sequence opt3 from capsid_protein_VP2__Norovirus__CRL46977
auggccggcgcuuucuuugcagggcuggccagcgacgugcucggauccggucuuggcucucugaucaacgcgggggcuggagccauuaaucagaaggucgaguucgaaaacaauagaaaauugcaacaggcaucauuucaguucaguagcuccuuacagcaagccucuuuucagcacgauaaggagaugcugcaggcucagauagaagcaaccaaaaagcuacaacaggagaugaugaggguuaaacaggccaugcuccuggaaggcgguuucucggagacagacgcugcccgcggggcgaucaacgcacccaugacuaagacgcuugauuggucaggaacccgguacugggccccugacgcucgaacaacuaccuauaaugccggccguuuuagcacaccacagccgaguggcgcacugcccgggagagcuaacuugagggccaccgcgccugcccggggauccucuagcauguccucaaauaguagcauugcaacuucuguguacuccaaccaaacaaccucaacgcgccucgguagcacugcuggcagugggaccucuguauccagccugccaucgacagccagaacuaggucuuggguggaggaucagaaucggaaccugucccccuucaugcgcggagcucauaauaucucauuugucaccccuccaaguagccgauccucuagccagggcacagugucaaccguucccaaggaagugcucgacaguuggacgggugccuucaacacuagaaggcaaccuuuauuugcacacauucggaaacguggggagucccgcgccuga

SEQ ID NO: 22050 - RNA, 807 nt, Artificial Sequence
  derived and/or modified sequence opt3 from capsid_protein_VP2__Norovirus__CRL46980
auggccggcgcuuuccuggcagggcucgccagcgacgugcuuggauccggucugggcucuuugaucaacgcgggggcuggagccauuaaucagaaggucgaguuugaaaacaauagaaaauuacaacaggcaucauuccaguuuaguagcucccugcagcaagccucuuuccagcacgauaaggagaugcuacaggcucagauagaagcaaccaaaaagcuccaacaggagaugaugaggguuaaacaggccaugcugcuugaaggcgguuuuucggagacagacgcugcccgcggggcgaucaacgcacccaugacuaagacgcuggauuggucaggaacccgguacugggccccugacgcucgaacaacuaccuauaaugccggccguuucagcacaccacagccgaguggcgcauugcccgggagagcuaaccucagggccaccgcgccugcccggggauccucuagcauguccucaaauaguagcauugcaacuucuguguacuccaaccaaacaaccucaacgcgccuggguagcacugcuggcagugggaccucuguauccagccugccaucgacagccagaacuaggucuuggguggaggaucagaaucggaaccucucccccuuuaugcgcggagcucauaauaucucauucgucaccccuccaaguagccgauccucuagccagggcacagugucaaccguucccaaggaaguguuagacaguuggacgggugccuuuaacacuagaaggcaaccucuguucgcacacauucggaaacguggggagucccgcgccuga

SEQ ID NO: 22051 - RNA, 1623 nt, Artificial Sequence
  derived and/or modified sequence opt4 from capsid_protein_VP1__Norovirus__ABY65350
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcagagcagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccgugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22052 - RNA, 1623 nt, Artificial Sequence
  derived and/or modified sequence opt4 from capsid_protein_VP1__Norovirus__ACO55068
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcacccacaacuacaccaugaaccuggccagccagaacuggaacaacuacgaccccgccgaggagauccccgccccccugggcacccccgacuucgugggcagaauccagggcgugcugacccagaccaccagaggcgacggcagcaccagaggccacaaggccaccgugagcaccggcgacgugcacuucacccccaagcugggcagcauccaguucaacaccgacaccaacaacgacuucgagaccggccagaacaccaaguucacccccgugggcguggugcaggacggcaacggcacccaccagaacgagccccagcagugggugcugcccagcuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22053 - RNA, 1623 nt, Artificial Sequence
  derived and/or modified sequence opt4 from capsid_protein_VP1__Norovirus__ADI45808
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguuccccagaaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagagacuguacaccggccccagcagcgccuucguggugcagccccagaacggcagaugcaccaccgacggcgugcugcugggcaccacccagcugagcgccgugaacaucugcaccuucagaggcgacgugacccacaucgccggcagcagaaacuacaccaugaaccuggccagccagaacuggaacaacuacgaccccaccgaggagauccccgccccccugggcacccccgacuucgugggcaagauccagggcaugcugacccagaccaccagaagcgacggcagcaccagaggccacaaggccaccgugcugaccggcagcgccgacuucgcccccaagcugggcagagugcaguucgccaccgacaccgacaacgacuucgagagcggccagaacaccaaguucacccccgugggcgugauccaggacggcagcaccacccacagaaacgagccccagcagugggugcugcccaacuacagcggcagaaccggccacaacgugcaccuggcccccgccguggcccccaccuaccccggcgagcagcugcuguucuucagaagcaccaugcccggcugcagcggcuaccccaacauggaccuggacugccugaucccccaggacugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22054 - RNA, 1623 nt, Artificial Sequence
  derived and/or modified sequence opt4 from capsid_protein_VP1__Norovirus__ADI45811
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccccuggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccacccagaacuggaacagcuacgaccccaccgaggagauccccgccccccugggcacccccgacuucgugggcaagauccagggcgugcugacccagaccaccagagccgacggcagcaccagaggccacaaggccaccguguacaccggcagcgccgacuucgcccccaagcugggcagagugcaguucgccaccgacaccgacaacgacuucgacgccaaccagaacaccaaguucacccccgugggcgugauccaggacggcgacaccgcccacagaaacgagccccagcagugggugcugcccagcuacagcggcagaaacagccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22055 - RNA, 1623 nt, Artificial Sequence
  derived and/or modified sequence opt4 from capsid_protein_VP1__Norovirus__ADI45812
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccacccagaacuggaacagcuacgaccccaccgaggagauccccgccccccugggcacccccgacuucgugggcaagauccagggcgugcugacccagaccaccagagccgacggcagcaccagaggccacaaggccaccguguacaccggcagcgccgacuucacccccaagcugggcagagugcaguucgccaccgacaccgacaacgacuucgacgccaaccagaacaccaaguucacccccgugggcgugauccaggacggcaacaccgcccacagaaacgagccccagcagugggugcugcccagcuacagcggcagaaacagccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22056 - RNA, 1623 nt, Artificial Sequence
  derived and/or modified sequence opt4 from capsid_protein_VP1__Norovirus__ADI45814
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccacccagaacuggaacagcuacgaccccaccgaggagauccccgccccccugggcacccccgacuucgugggcaagauccagggcgugcugacccagaccaccagagccgacggcagcaccagaggccacaaggccaccguguacaccggcagcgccgacuucgcccccaagcugggcagagugcaguucgccaccgacaccgacaacgacuucgacgccaaccagaacaccaaguucacccccgugggcgugauccaggacggcgacaccgcccacagaaacgagccccagcagugggugcugcccagcuacagcggcagaaacagccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22057 - RNA, 1623 nt, Artificial Sequence
  derived and/or modified sequence opt4 from capsid_protein_VP1__Norovirus__ADI45815
augaagauggccagcagcgacgccaaccccuucgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccacccagaacuggaacagcuacgaccccaccgaggagauccccgccccccugggcacccccgacuucgugggcaagauccagggcgugcugacccagaccaccagagccgacggcagcaccagaggccacaaggccaccguguacaccggcagcgccgacuucgcccccaagcugggcagagugcaguucgccaccgacaccgacaacgacuucgacgccaaccagaacaccaaguucacccccgugggcgugauccaggacggcaacaccgcccacagaaacgagccccagcagugggugcugcccagcuacagcggcagaaacagccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22058 - RNA, 1623 nt, Artificial Sequence
  derived and/or modified sequence opt4 from capsid_protein_VP1__Norovirus__ADI45816
augaagauggccagcaacgacgccaaccccagcgacggcagcgccgccaaccuggugcccgagaucaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccccgccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaaggaggacggcagcaccagaggccacaaggccaccguguacaccggcagcgccgacuucacccccaagcugggcagcgugcaguucggcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaacuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22059 - RNA, 1623 nt, Artificial Sequence
  derived and/or modified sequence opt4 from capsid_protein_VP1__Norovirus__ADI45817
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccccgugccccccaccguggagagcagaaccaagcccuucaccgugcccauccugaccguggaggagaugaccaacagcagauuccccaucccccuggagagacuguacaccggccccagcagcgccuucguggugcagccccagaacggcagaugcaccaccgacggcgugcugcugggcaccacccagcugagcgccgugaacaucugcaccuucagaggcgacgugacccacaucgccggcagcagaaacuacaccaugaaccuggccagccagaacuggaacaacuacgaccccaccgaggagauccccgccccccugggcacccccgacuucgugggcaagauccagggcaugcugacccagaccaccagaagcgacggcagcaccagaggccacaaggccaccgugcugaccggcagcgccgacuucgcccccaagcugggcagagugcaguucgccaccgacaccgacaacgacuucgagagcggccagaacaccaaguucacccccgugggcgugauccaggacggcagcaccacccacagaaacgagccccagcagugggugcugcccaacuacagcggcagaaccggccacaacgugcaccuggcccccgccguggcccccaccuaccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagccguguga

SEQ ID NO: 22060 - RNA, 1623 nt, Artificial Sequence
  derived and/or modified sequence opt4 from capsid_protein_VP1__Norovirus__ADI45818
augaagauggccagcagcgacgcccaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggccuacaccggccagcacgaccuggugaucccccccaacggcuacuucagauucgacagcugggugaaccaguucuacacccuggcccccaugggcaacggcaccggcagaagaagagcccuguga

SEQ ID NO: 22061 - RNA, 1626 nt, Artificial Sequence
  derived and/or modified sequence opt4 from capsid_protein_VP1__Norovirus__AET79296
augagaaugagcgacggcgccgcccccaaggccaacggcagcgaggccagcggccaggaccuggugcccaccgccguggagcaggccgugcccauccagcccguggccggcgccagccuggccgcccccgccgccggccagaucaaccagaucgaccccuggaucuuccagaacuucgugcagugcccccugggcgaguucagcaucagccccagaaacacccccggcgagauccuguucgaccuggcccugggccccggccugaaccccuaccuggcccaccugagcgccauguacaccggcugggugggcaacauggaggugcagcuggugcuggccggcaacgccuucaccgccggcaagguggugguggcccuggugccccccuacuuccccaagggcagccugaccaccgcccagaucaccugcuucccccacgugaugugcgacgugagaacccuggagcccauccagcugccccugcuggacgugagaagagugcuguggcacgccacccaggaccaggaggagagcaugagacuggugugcaugcuguacaccccccugagaaccaacagccccggcgacgagagcuucguggugagcggcagacugcugagcaagcccgccgccgacuucaacuucguguaccugaccccccccaucgagagaaccaucuacagaaugguggaccugcccgugcugcagcccagacugugcacccacgccagauggcccgcccccguguacggccugcugguggaccccagccugcccagcaacccccaguggcagaacggcagagugcacguggacggcacccugcugggcaccacccccgugagcggcagcugggugagcugcuucgccgccgaggccgccuacgaguuccagagcggcaccggcgagguggccaccuucacccugaucgagcaggacggcagcgccuacgugcccggcgacagagccgccccccugggcuaccccgacuucagcggccagcuggagaucgaggugcagaccgagaccaccaaggccggcgacaagcugaaggugaccaccuucgagaugauccugggccccaccaccaacguggaccaggcccccuaccagggcagagugcacgccagcaccagcgugaccgccagccugaaccugguggacggcagagugagagccgugcccagaagcaucuacagcuuccaggacguggugcccgaguacaacgacggccugcuggugccccuggccccccccaucggccccuuccugcccggcgaggugcugcugagauucagaaccuacaugagacagaucgacagcagcgacgccgccgccgaggccaucgacugcgcccugccccaggaguucaucagcugguucgccagcaacgccuucaccgugcagagcgaggcccugcugcugagauacagaaacacccugaccggccagcugcuguucgagugcaagcuguacagcgagggcuacaucgcccugagcuacagcggcagcggcccccugaccuuccccaccgacggcuucuucgagguggugagcugggugcccagacuguaccagcuggccagcgugggcagccuggccaccggcagaacccugaagcaguga

SEQ ID NO: 22062 - RNA, 1626 nt, Artificial Sequence
  derived and/or modified sequence opt4 from capsid_protein_VP1__Norovirus__AFB18026
augagaaugagcgacggcgccacccccaagcccaacggcagcgaggccgccggccaggaccuggugcccagcagcguggagcaggccauccccauccagcccguggccggcgccgccguggccgcccccaccgccggccagaucaaccagaucgaccccuggaucuuccagaacuucgugcagugcccccugggcgaguucagcaucagccccagaaacacccccggcgagauccuguucgaccuggcccugggccccggccugaaccccuaccuggcccaccugagcgccauguacaccggcugggugggcaacauggaggugcagcuggugcuggccggcaacgccuucaccgccggcaagguggugguggcccuggugccccccuacuucccccagggcagccugaccaccgcccagaucaccugcuucccccacgugaugugcgacgugagaacccuggagcccauccagcugccccugcuggacgugagaagagugcuguggcacgccacccagaaccaggaggaggccaugagacuggugugcaugcuguacaccccccugagaaccaacagccccggcgacgagagcuucguggugagcggcagacugcugagcagacccagccccgacuucaacuucguguaccugaccccccccaucgagagaaccaucuacagaaugguggaccugcccguggugcagcccagacugugcacccacagcagauggcccgcccccguguaccagauccugguggaccccagccugcccagcaacccccaguggcagaacggcagagugcugaucgacggcacccugcugggcaccacccccaucagcagcagcuggguggccagcuucgccggcaccgccgaguacagcuuccagagcccccccagcgccgagaucggcgaggugagccuguucgagaucgacggcagcgccuacacccccggcgacagagccgccccccugggcuaccccgacuucagcggcacccuggagguggagauccagaccgagaccaccaaggccggccagaagcuggacgugcacaccuucaaccuggagcugaagagccagaccguggaccaggcccccuuccagggcaagguguacauggaccuggaggccagcgccagccuggaccuggugaacggcagagugagagccagccccagaagcguggccgccuucaaggacgagcugcccagcuacaacagcggccugcuggugccccuggcccccccccugggccccuuccugcccggcgaggugcugcugagauucagaaccuucgccagacagguggacaccaccgacgccagcgcccaggccguggacugcgcccugccccaggagcuggugagcugguucgccagcagcaacuucaccgugcagagcgaggcccugcugcugagauacagaaacacccugaccggccagcugcuguucgagugcaagcuguacagcgagggcuacaucgcccugagcuacaccggcagcagcccccugaccuuccccaccgacggcuuccuggagguggugagcugggugcccagacugcaccagcuggccagcgugggcagccuggccaccggcagaagccugaagcaguga

SEQ ID NO: 22063 - RNA, 1626 nt, Artificial Sequence
  derived and/or modified sequence opt4 from capsid_protein_VP1__Norovirus__AFB18027
augagaaugagcgacggcgccacccccaagcccaacggcagcgaggccgccggccaggaccuggugcccagcagcguggagcaggccauccccauccagcccguggccggcgccgccguggccgcccccaccgccggccagaucaaccagaucgaccccuggaucuuccagaacuucgugcagugcccccugggcgaguucagcaucagccccagaaacacccccggcgagauccuguucgaccuggcccugggccccggccugaaccccuaccuggcccaccugagcgccauguacaccggcugggugggcaacauggaggugcagcuggugcuggccggcaacgccuucaccgccggcaagguggugguggcccuggugccccccuacuuccccaagggcagccugaccaccgcccagaucaccugcuucccccacgugaugugcgacgugagaacccuggagcccauccagcugccccugcuggacgugagaagagugcuguggcacgccacccaggaccaggaggaggccaugagacuggugugcaugcuguacaccccccugagaaccaacagccccggcgacgagagcuucguggugagcggcagacugcugagcagacccgccagcgacuucaacuucguguaccugaccccccccaucgagagaaccaucuacagaaugguggaccugcccguggugcagcccagacugugcacccacagcagauggcccgcccccguguaccagauccugguggaccccagccugcccagcaacccccaguggcagaacggcagagugcagguggacggcacccugcugggcaccacccccgugagcggcagcuggguggccagcuucgccggcaccgccgaguacagcuuccagaccccccccagcgccgagaucggcaccaucagccuguucgagaucgacggcagcgccuacgugcccggcgacagagccgccccccugggcuaccccgacagcgccggcacccuggagguggagauccagaccgagaccaccaaggccggccagaagcugaacgugcacaccuucagccuggagcuggugagccagaccguggaccaggcccccuaccagggccagaucuucguggaccuggagaccagcagcagcauggaccuggugaacggcagagugagagccagccccagaagcaucagcggcuucaaggacgagcugcccagcuacaacaacggccugcuggugccccuggcccccccccugggccccuuccugcccggcgaggugcugcugagauucagaaccuucgccggccagguggaccugaccgacgccgccgcccagcccguggacugcgcccugccccaggaguucgugagcugguucgccagcaacaacuucaccgugcagagcgaggcccugcugcugagauacagaaacacccugaccggccagcugcuguucgagugcaagcuguacagcgagggcuacaucgcccugagcuacaccggcagcggcccccugaccuuccccaccgacggcuucuucgagguggugagcugggugcccagacuguaccagcuggccagcgugggcagccuggccaccggcagaagccugaagcaguga

SEQ ID NO: 22064 - RNA, 1635 nt, Artificial Sequence
  derived and/or modified sequence opt4 from capsid_protein_VP1__Norovirus__AFI08231
augaugauggccagcaaggacgcccccaccaacauggacggcaccagcggcgccggccagcuggugcccgaggccaacaccgccgagcccaucagcauggaccccguggccggcgccgccaccgccguggccaccgccggccagaucaacaugaucgaccccuggaucaugagcaacuucgugcaggccccccagggcgaguucaccgugagccccaacaacacccccggcgacgugcuguucgaccugcagcugggcccccagcugaaccccuuccuggcccaccuggcccagauguacaacggcugggugggcaacaugagagugaaggugcugcuggccggcaacgccuucaccgccggcaagaucaucaucagcugcaucccccccggcuucaccagccagaacaucagcaucgcccagaugaccauguucccccacgugaucgccgacgugagagugcuggagcccaucgagaucccccuggaggacgugagaaacgugcuguuccacaccaacgacaacagacccaccaugagacuggugugcaugcuguacaccccccugagagccaacggcagcagcagcggcaccgaccccuucgugaucgccggcagagugcugaccugccccgacagcaacuucagcuuccuguuccuggugccccccaacguggagcagaagaccagacccuucagcgugcccaacaucccccugaacacccugagcaacagcagagugcccagccugaucaagagcaugaccaucagcagagaccagaaccagaucauccaguuccagaacggcagagugacccuggacggccagcugcagggcaccacccccaccagcgugagccagcugugcaagaucagaggcaccaccuaccacgccaccggcggcaacggcaucaaccugaccgagcugaacggcgagcccuaccacgccuucgagagccccgcccccaucggcuuccccgaccugggcggcugcgacuggcaccugaccgccacccccacccaggccuucaacgacggcgccaagguggugagacugagcgugacccagggcgccgccuucgccccccaccugggcaccauccacuacaccaccaccgacaccgacuacaaccccaacaccagcaucaucugcacccuggacuggcugagccagaccgccggccagagcaacguggaccccuggcagauccccaccuacggcagcacccugaccgaggccgcccagcuggccccccccaucuucccccccggcuucggcgagacccugguguucuuccugagcgacuuccccaucagcaacggcaagaacggccugagcgugcccugcacccugccccaggaguucgugacccacuucgugaacgagcaggcccccaucagaggcgaggccgcccugcugcacuacguggaccccgacacccacagaaaccugggcgaguucaagcuguaccccgagggcuucaugaccugcgugcccaacaccagcggcggcggcccccagacccugcccaucaacggcguguucguguucgugagcugggugagcagauucuaccagcugaagcccgugggcaccgccggcgccgccagaagacugggcaucagaagaagcuga

SEQ ID NO: 22065 - RNA, 1623 nt, Artificial Sequence
  derived and/or modified sequence opt4 from capsid_protein_VP1__Norovirus__AFI08240
augaagauggccagcaacgacgccaaccccagcgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagaccaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22066 - RNA, 1620 nt, Artificial Sequence
  derived and/or modified sequence opt4 from capsid_protein_VP1__Norovirus__AFS33552
augaagauggccagcagcgacgccaaccccagcgacggcagcgccgccaaccuggugcccgaggugaacaacgaggugauggcccuggagcccguggugggcgccgccaucgccgcccccguggccggccagcagaacaucaucgaccccuggaucagaaacaacuucgugcaggcccccggcggcgaguucaccgugagccccagaaacgcccccggcgagauccuguggagcgccccccugggccccgaccugaaccccuaccugagccaccugagcagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagccacgacagcacccugaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaacuucagaggcgacgugacccacaucgugggcagccacgacuacaccaugaaccuggccagccagaacuggagcaacuacgaccccaccgaggagauccccgccccccugggcacccccgacuucgugggcaagauccagggccugcugacccagaccaccagagccgacggcagcaccagagcccacaaggccaccgugagcaccggcagcgugcacuucacccccaagcugggcagcgugcaguucaccaccgacaccaacaacgacuuccagaccggccagaacaccaaguucacccccgugggcgugauccaggacggcgaccaccaccagaacgagccccagcagugggugcugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcugcacuucuaccaggaggccgcccccgcccagagcgacguggcccugcugagauucgugaaccccgacaccggcagagugcuguucgagugcaagcugcacaagagcggcuacaucaccguggcccacaccggccccuacgaccuggugaucccccccaacggcuacuucagauucgacagcugggugaaccaguucuacacccuggcccccaugggcaacggcaccggcagaagaagagcccuguga

SEQ ID NO: 22067 - RNA, 1608 nt, Artificial Sequence
  derived and/or modified sequence opt4 from capsid_protein_VP1__Norovirus__AFS33555
augaagauggccagcaacgacgccgcccccagcaacgacggcgccgccggccuggugcccgaggugaacaacgagaccauggcccuggagcccguggccggcgccagcaucgccgccccccugaccggccagaacaacgugaucgaccccuggaucagaaugaacuucgugcaggcccccaacggcgaguucaccgugagccccagaaacagccccggcgagauccugcugaaccuggagcugggccccgagcugaaccccuuccuggcccaccugagcagaauguacaacggcuacgccggcggcguggaggugcaggugcugcuggccggcaacgccuucaccgccggcaagcugguguucgccgccauccccccccacuucccccuggagaaccugagccccggccagaucaccauguucccccacgugaucaucgacgugagaacccuggagcccgugcugcugccccugcccgacgugagaaacaacuucuuccacuacaaccagcagcccgagcccagaaugagacugguggccaugcuguacaccccccugagaagcaacggcagcggcgacgacguguucaccgugagcugcagagugcugaccagacccagccccgacuucgacuucaacuaccuggugccccccaccguggagagcaagaccaagcccuucacccugcccauccugaccaucggcgagcugagcaacagcagauuccccgugcccaucgacgagcuguacaccagccccaacgagggcgugaucgugcagccccagaacggcagaagcacccuggacggcgagcugcugggcaccacccagcuggugcccagcaacaucugcgcccugagaggcagaaucaacgcccaggugcccgacgaccaccaccaguggaaccugcaggugaccaacaccaacggcacccccuucgaccccaccgaggacgugcccgccccccugggcacccccgacuuccuggccaacaucuacggcgugaccagccagagaaaccccaacaacaccugcagagcccacgacggcgugcuggccaccuggagccccaaguucacccccaagcugggcagcgugauccugggcaccugggaggagagcgaccuggaccugaaccagcccaccagauucacccccgugggccuguucaacaccgaccacuucgaccagugggcccugcccagcuacagcggcagacugacccugaacaugaaccuggcccccagcgugagcccccuguuccccggcgagcagcugcuguucuucagaagccacaucccccugaagggcggcaccagcgacggcgccaucgacugccugcugccccaggaguggauccagcacuucuaccaggagagcgcccccagccccaccgacguggcccugaucagauacaccaaccccgacaccggcagagugcuguucgaggccaagcugcacagacagggcuucaucaccguggccaacagcggcagcagacccaucguggugccccccaacggcuacuucagauucgacagcugggugaaccaguucuacagccuggcccccaugggcaccggcaacggcagaagaagagugcaguga

SEQ ID NO: 22068 - RNA, 1623 nt, Artificial Sequence
  derived and/or modified sequence opt4 from capsid_protein_VP1__Norovirus__AFW15938
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgcccagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22069 - RNA, 1623 nt, Artificial Sequence
  derived and/or modified sequence opt4 from capsid_protein_VP1__Norovirus__AFW15940
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcaagaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgcccagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22070 - RNA, 1623 nt, Artificial Sequence
  derived and/or modified sequence opt4 from capsid_protein_VP1__Norovirus__AFW15941
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22071 - RNA, 1623 nt, Artificial Sequence
  derived and/or modified sequence opt4 from capsid_protein_VP1__Norovirus__AFW15944
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggagcagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22072 - RNA, 1623 nt, Artificial Sequence
  derived and/or modified sequence opt4 from capsid_protein_VP1__Norovirus__AFW15947
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22073 - RNA, 1623 nt, Artificial Sequence
  derived and/or modified sequence opt4 from capsid_protein_VP1__Norovirus__AFW15948
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcaacgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22074 - RNA, 1623 nt, Artificial Sequence; identical to SEQ ID NO: 22072
  derived and/or modified sequence opt4 from capsid_protein_VP1__Norovirus__AFW15949

SEQ ID NO: 22075 - RNA, 1623 nt, Artificial Sequence
  derived and/or modified sequence opt4 from capsid_protein_VP1__Norovirus__AFW15950
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacgugugcaccuucagaggcgacgugacccacaucagcggcagcagaaacuacaccaugaaccuggccagccagaacuggaccagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22076 - RNA, 1623 nt, Artificial Sequence
  derived and/or modified sequence opt4 from capsid_protein_VP1__Norovirus__AFW15951
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaccagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22077 - RNA, 1653 nt, Artificial Sequence
  derived and/or modified sequence opt4 from capsid_protein_VP1__Norovirus__AFX71665
augaagauggccagcaacgacgccgcccccagcaacgacggcgccgccaaccuggugcccgaggccaacaacgaggugauggcccuggagcccguggugggcgccagcaucgccgcccccguggugggccagcagaacaucaucgaccccuggaucagagagaacuucgugcaggccccccagggcgaguucaccgugagccccagaaacagccccggcgagaugcugcugaaccuggagcugggccccgagcugaaccccuaccugagccaccugagcagaauguacaacggcuacgccggcggcaugcaggugcagguggugcuggccggcaacgccuucaccgccggcaagaucaucuucgccgccgugcccccccacuuccccguggagaacaucagcgccgcccagaucaccaugugcccccacgugaucguggacgugagacagcuggagcccgugcugcugccccugcccgacaucagaaacagauucuuccacuacaaccaggagaacacccccagaaugagacugguggccaugcuguacaccccccugagagccaacagcggcgaggacguguucaccgugagcugcagagugcugaccagacccgcccccgacuucgaguucaccuuccuggugccccccaccguggagagcaagaccaagcccuucacccugcccauccugacccugggcgagcugagcaacagcagauuccccgccgccaucgacaugcuguacaccgaccccaacgagagcaucguggugcagccccagaacggcagaugcacccuggacggcacccugcagggcaccacccagcuggugcccacccagaucugcgccuucagaggcacccugaucagccagaccgccagagccgccgacagcaccgacagcccccagagagccagaaaccacccccugcacgugcaggugaagaaccuggacggcacccaguacgaccccaccgacgacauccccgccgugcugggcgccaucgacuuccagggcaccguguucggcguggccagccagagagacgugagcggccagcaggagcagggccacuacgccaccagagcccacgaggcccacaucgacaccaccgaccccaaguacgcccccaagcugggcaccauccugaucaagagcgacagcgacgacuucaacaccaaccagcccaucagauucacccccgugggcaugggcgacaacaacuggagacagugggagcugcccgacuacagcggcagacugacccugaacaugaaccuggcccccgccgugagccccagcuuccccggcgagagaauccuguucuucagaagcaucgugcccagcgccggcggcuacggcagcggcuacaucgacugccugaucccccaggagugggugcagcacuucuaccaggaggccgcccccagccagagcgccguggcccuggugagauacgugaaccccgacaccggcagaaacaucuucgaggccaagcugcacagagagggcuuccugaccguggccaacagcggcaacaaccccaucguggugccccccaacggcuacuucagauucgaggccugggugaaccaguucuacacccuggcccccaugggcagcggccagggcagaagaagagcccaguga

SEQ ID NO: 22078 - RNA, 1623 nt, Artificial Sequence
  derived and/or modified sequence opt4 from capsid_protein_VP1__Norovirus__AFX71668
augaagauggccagcagcgacgccagccccagcgacggcagcaccgccaaccuggugcccgaggugaacaacgaggugauggcccuggagcccguggccggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagcugaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcaacaccacccccagaaacgagccccagcagugggugcugcccagcuacagcggcagaaacauccagaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22079 - RNA, 1623 nt, Artificial Sequence; identical to SEQ ID NO: 22065
  derived and/or modified sequence opt4 from capsid_protein_VP1__Norovirus__AFX81121

SEQ ID NO: 22080 - RNA, 1623 nt, Artificial Sequence; identical to SEQ ID NO: 22065
  derived and/or modified sequence opt4 from capsid_protein_VP1__Norovirus__AFX81127

SEQ ID NO: 22081 - RNA, 1623 nt, Artificial Sequence; identical to SEQ ID NO: 22065
  derived and/or modified sequence opt4 from capsid_protein_VP1__Norovirus__AFX81130

SEQ ID NO: 22082 - RNA, 1623 nt, Artificial Sequence; identical to SEQ ID NO: 22065
  derived and/or modified sequence opt4 from capsid_protein_VP1__Norovirus__AFX81136

SEQ ID NO: 22083 - RNA, 1623 nt, Artificial Sequence; identical to SEQ ID NO: 22065
  derived and/or modified sequence opt4 from capsid_protein_VP1__Norovirus__AFX81139

SEQ ID NO: 22084 - RNA, 1623 nt, Artificial Sequence; identical to SEQ ID NO: 22065
  derived and/or modified sequence opt4 from capsid_protein_VP1__Norovirus__AFX81142

SEQ ID NO: 22085 - RNA, 1623 nt, Artificial Sequence; identical to SEQ ID NO: 22065
  derived and/or modified sequence opt4 from capsid_protein_VP1__Norovirus__AFX81145

SEQ ID NO: 22086 - RNA, 1623 nt, Artificial Sequence; identical to SEQ ID NO: 22065
  derived and/or modified sequence opt4 from capsid_protein_VP1__Norovirus__AFX81148

SEQ ID NO: 22087 - RNA, 1623 nt, Artificial Sequence; identical to SEQ ID NO: 22065
  derived and/or modified sequence opt4 from capsid_protein_VP1__Norovirus__AFX81154

SEQ ID NO: 22088 - RNA, 1623 nt, Artificial Sequence; identical to SEQ ID NO: 22065
  derived and/or modified sequence opt4 from capsid_protein_VP1__Norovirus__AFX81157

SEQ ID NO: 22089 - RNA, 1623 nt, Artificial Sequence; identical to SEQ ID NO: 22065
  derived and/or modified sequence opt4 from capsid_protein_VP1__Norovirus__AFX81163

SEQ ID NO: 22090 - RNA, 1623 nt, Artificial Sequence
  derived and/or modified sequence opt4 from capsid_protein_VP1__Norovirus__AFX81166
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22091 - RNA, 1623 nt, Artificial Sequence; identical to SEQ ID NO: 22065
  derived and/or modified sequence opt4 from capsid_protein_VP1__Norovirus__AFX81169

SEQ ID NO: 22092 - RNA, 1623 nt, Artificial Sequence; identical to SEQ ID NO: 22065
  derived and/or modified sequence opt4 from capsid_protein_VP1__Norovirus__AFX81172

SEQ ID NO: 22093 - RNA, 1623 nt, Artificial Sequence; identical to SEQ ID NO: 22065
  derived and/or modified sequence opt4 from capsid_protein_VP1__Norovirus__AFX81178

SEQ ID NO: 22094 - RNA, 1623 nt, Artificial Sequence; identical to SEQ ID NO: 22065
  derived and/or modified sequence opt4 from capsid_protein_VP1__Norovirus__AFX81181

SEQ ID NO: 22095 - RNA, 1623 nt, Artificial Sequence; identical to SEQ ID NO: 22065
  derived and/or modified sequence opt4 from capsid_protein_VP1__Norovirus__AFX81190

SEQ ID NO: 22096 - RNA, 1623 nt, Artificial Sequence; identical to SEQ ID NO: 22065
  derived and/or modified sequence opt4 from capsid_protein_VP1__Norovirus__AFX81193

SEQ ID NO: 22097 - RNA, 1623 nt, Artificial Sequence; identical to SEQ ID NO: 22065
  derived and/or modified sequence opt4 from capsid_protein_VP1__Norovirus__AFX81196

SEQ ID NO: 22098 - RNA, 1623 nt, Artificial Sequence
  derived and/or modified sequence opt4 from capsid_protein_VP1__Norovirus__AFX81199
augaagauggccagcaacgacgccaaccccagcgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagaccaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagagacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22099 - RNA, 1623 nt, Artificial Sequence; identical to SEQ ID NO: 22065
  derived and/or modified sequence opt4 from capsid_protein_VP1__Norovirus__AFX81202

SEQ ID NO: 22100 - RNA, 1623 nt, Artificial Sequence
  derived and/or modified sequence opt4 from capsid_protein_VP1__Norovirus__AFX81205
augaagauggccagcaacgacgccaaccccagcgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagaccaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggcccugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22101 - RNA, 1623 nt, Artificial Sequence; identical to SEQ ID NO: 22065
  derived and/or modified sequence opt4 from capsid_protein_VP1__Norovirus__AFX81208

SEQ ID NO: 22102 - RNA, 1623 nt, Artificial Sequence; identical to SEQ ID NO: 22065
  derived and/or modified sequence opt4 from capsid_protein_VP1__Norovirus__AFX81211

SEQ ID NO: 22103 - RNA, 1623 nt, Artificial Sequence; identical to SEQ ID NO: 22065
  derived and/or modified sequence opt4 from capsid_protein_VP1__Norovirus__AFX81214

SEQ ID NO: 22104 - RNA, 1623 nt, Artificial Sequence; identical to SEQ ID NO: 22065
  derived and/or modified sequence opt4 from capsid_protein_VP1__Norovirus__AFX81226

SEQ ID NO: 22105 - RNA, 1623 nt, Artificial Sequence
  derived and/or modified sequence opt4 from capsid_protein_VP1__Norovirus__AFX81229
augaagauggccagcaacgacgccaaccccagcgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagaccaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugagccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22106 - RNA, 1623 nt, Artificial Sequence; identical to SEQ ID NO: 22065
  derived and/or modified sequence opt4 from capsid_protein_VP1__Norovirus__AFX81232

SEQ ID NO: 22107 - RNA, 1623 nt, Artificial Sequence; identical to SEQ ID NO: 22065
  derived and/or modified sequence opt4 from capsid_protein_VP1__Norovirus__AFX81238

SEQ ID NO: 22108 - RNA, 1623 nt, Artificial Sequence
  derived and/or modified sequence opt4 from capsid_protein_VP1__Norovirus__AFX81241
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22109 - RNA, 1623 nt, Artificial Sequence
  derived and/or modified sequence opt4 from capsid_protein_VP1__Norovirus__AFX81247
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacugggacagcuacgaccccaccgaggagacccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22110 - RNA, 1623 nt, Artificial Sequence
  derived and/or modified sequence opt4 from capsid_protein_VP1__Norovirus__AFX81250
augaagauggccagcagcgacgccaaccccagcaacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccagcagccacaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuuccagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22111 - RNA, 1623 nt, Artificial Sequence; identical to SEQ ID NO: 22108
  derived and/or modified sequence opt4 from capsid_protein_VP1__Norovirus__AFX81253

SEQ ID NO: 22112 - RNA, 1623 nt, Artificial Sequence
  derived and/or modified sequence opt4 from capsid_protein_VP1__Norovirus__AFX81256
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22113 - RNA, 1623 nt, Artificial Sequence; identical to SEQ ID NO: 22065
  derived and/or modified sequence opt4 from capsid_protein_VP1__Norovirus__AFX81262

SEQ ID NO: 22114 - RNA, 1623 nt, Artificial Sequence; identical to SEQ ID NO: 22065
  derived and/or modified sequence opt4 from capsid_protein_VP1__Norovirus__AFX81265

SEQ ID NO: 22115 - RNA, 1623 nt, Artificial Sequence
  derived and/or modified sequence opt4 from capsid_protein_VP1__Norovirus__AFX81268
augaagauggccagcaacgacgccaaccccagcgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugagagugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagaccaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22116 - RNA, 1623 nt, Artificial Sequence; identical to SEQ ID NO: 22065
  derived and/or modified sequence opt4 from capsid_protein_VP1__Norovirus__AFX81271

SEQ ID NO: 22117 - RNA, 1623 nt, Artificial Sequence
  derived and/or modified sequence opt4 from capsid_protein_VP1__Norovirus__AFX81274
augaagauggccagcaacgacgccaaccccagcgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugagagugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagaccaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugagcaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22118 - RNA, 1623 nt, Artificial Sequence; identical to SEQ ID NO: 22115
  derived and/or modified sequence opt4 from capsid_protein_VP1__Norovirus__AFX81277

SEQ ID NO: 22119 - RNA, 1623 nt, Artificial Sequence
  derived and/or modified sequence opt4 from capsid_protein_VP1__Norovirus__AFX81283
augaagauggccagcaacgacgccaaccccagcgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagaccaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22120 - RNA, 1623 nt, Artificial Sequence; identical to SEQ ID NO: 22065
  derived and/or modified sequence opt4 from capsid_protein_VP1__Norovirus__AFX81289

SEQ ID NO: 22121 - RNA, 1623 nt, Artificial Sequence; identical to SEQ ID NO: 22065
  derived and/or modified sequence opt4 from capsid_protein_VP1__Norovirus__AFX81292

SEQ ID NO: 22122 - RNA, 1623 nt, Artificial Sequence; identical to SEQ ID NO: 22065
  derived and/or modified sequence opt4 from capsid_protein_VP1__Norovirus__AFX81295

SEQ ID NO: 22123 - RNA, 1623 nt, Artificial Sequence; identical to SEQ ID NO: 22065
  derived and/or modified sequence opt4 from capsid_protein_VP1__Norovirus__AFX81298

SEQ ID NO: 22124 - RNA, 1623 nt, Artificial Sequence
  derived and/or modified sequence opt4 from capsid_protein_VP1__Norovirus__AFX81301
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22125 - RNA, 1623 nt, Artificial Sequence; identical to SEQ ID NO: 22065
  derived and/or modified sequence opt4 from capsid_protein_VP1__Norovirus__AFX81304

SEQ ID NO: 22126 - RNA, 1623 nt, Artificial Sequence; identical to SEQ ID NO: 22065
  derived and/or modified sequence opt4 from capsid_protein_VP1__Norovirus__AFX81307

SEQ ID NO: 22127 - RNA, 1623 nt, Artificial Sequence; identical to SEQ ID NO: 22065
  derived and/or modified sequence opt4 from capsid_protein_VP1__Norovirus__AFX81313

SEQ ID NO: 22128 - RNA, 1623 nt, Artificial Sequence; identical to SEQ ID NO: 22065
  derived and/or modified sequence opt4 from capsid_protein_VP1__Norovirus__AFX81316

SEQ ID NO: 22129 - RNA, 1623 nt, Artificial Sequence; identical to SEQ ID NO: 22065
  derived and/or modified sequence opt4 from capsid_protein_VP1__Norovirus__AFX81319

SEQ ID NO: 22130 - RNA, 1623 nt, Artificial Sequence; identical to SEQ ID NO: 22065
  derived and/or modified sequence opt4 from capsid_protein_VP1__Norovirus__AFX81322

SEQ ID NO: 22131 - RNA, 1623 nt, Artificial Sequence; identical to SEQ ID NO: 22065
  derived and/or modified sequence opt4 from capsid_protein_VP1__Norovirus__AFX81325

SEQ ID NO: 22132 - RNA, 1623 nt, Artificial Sequence; identical to SEQ ID NO: 22065
  derived and/or modified sequence opt4 from capsid_protein_VP1__Norovirus__AGE89433

SEQ ID NO: 22133 - RNA, 1623 nt, Artificial Sequence; identical to SEQ ID NO: 22065
  derived and/or modified sequence opt4 from capsid_protein_VP1__Norovirus__AGE89436

SEQ ID NO: 22134 - RNA, 1623 nt, Artificial Sequence; identical to SEQ ID NO: 22112
  derived and/or modified sequence opt4 from capsid_protein_VP1__Norovirus__AGE89439

SEQ ID NO: 22135 - RNA, 1623 nt, Artificial Sequence
  derived and/or modified sequence opt4 from capsid_protein_VP1__Norovirus__AGE89442
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaagcaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22136 - RNA, 1623 nt, Artificial Sequence
  derived and/or modified sequence opt4 from capsid_protein_VP1__Norovirus__AGE89445
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaagcaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22137 - RNA, 1623 nt, Artificial Sequence; identical to SEQ ID NO: 22112
  derived and/or modified sequence opt4 from capsid_protein_VP1__Norovirus__AGE89448

SEQ ID NO: 22138 - RNA, 1623 nt, Artificial Sequence; identical to SEQ ID NO: 22065
  derived and/or modified sequence opt4 from capsid_protein_VP1__Norovirus__AGE89451

SEQ ID NO: 22139 - RNA, 1623 nt, Artificial Sequence
  derived and/or modified sequence opt4 from capsid_protein_VP1__Norovirus__AGE89454
augaagauggccagcaacgacgccaaccccagcgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggggcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagaccaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaacggccagcacgaccuggugaucccccccaacggcuacuucagauucgacagcugggugaaccaguucuacacccuggcccccaugggcaacggcaccggcagaagaagagcccuguga

SEQ ID NO: 22140 - RNA, 1623 nt, Artificial Sequence; identical to SEQ ID NO: 22065
  derived and/or modified sequence opt4 from capsid_protein_VP1__Norovirus__AGE89457

SEQ ID NO: 22141 - RNA, 1623 nt, Artificial Sequence; identical to SEQ ID NO: 22065
  derived and/or modified sequence opt4 from capsid_protein_VP1__Norovirus__AGE89460

SEQ ID NO: 22142 - RNA, 1623 nt, Artificial Sequence; identical to SEQ ID NO: 22065
  derived and/or modified sequence opt4 from capsid_protein_VP1__Norovirus__AGE89463

SEQ ID NO: 22143 - RNA, 1623 nt, Artificial Sequence; identical to SEQ ID NO: 22065
  derived and/or modified sequence opt4 from capsid_protein_VP1__Norovirus__AGE89466

SEQ ID NO: 22144 - RNA, 1623 nt, Artificial Sequence; identical to SEQ ID NO: 22139
  derived and/or modified sequence opt4 from capsid_protein_VP1__Norovirus__AGE89472

SEQ ID NO: 22145 - RNA, 1623 nt, Artificial Sequence; identical to SEQ ID NO: 22115
  derived and/or modified sequence opt4 from capsid_protein_VP1__Norovirus__AGE89475

SEQ ID NO: 22146 - RNA, 1623 nt, Artificial Sequence; identical to SEQ ID NO: 22065
  derived and/or modified sequence opt4 from capsid_protein_VP1__Norovirus__AGE89478

SEQ ID NO: 22147 - RNA, 1623 nt, Artificial Sequence
  derived and/or modified sequence opt4 from capsid_protein_VP1__Norovirus__AGE89481
augaagauggccagcaacgacgccaaccccagcgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagaccaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaaggaggacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22148 - RNA, 1623 nt, Artificial Sequence; identical to SEQ ID NO: 22065
  derived and/or modified sequence opt4 from capsid_protein_VP1__Norovirus__AGE89490

SEQ ID NO: 22149 - RNA, 1623 nt, Artificial Sequence; identical to SEQ ID NO: 22065
  derived and/or modified sequence opt4 from capsid_protein_VP1__Norovirus__AGE89493

SEQ ID NO: 22150 - RNA, 1623 nt, Artificial Sequence
  derived and/or modified sequence opt4 from capsid_protein_VP1__Norovirus__AGE89496
augaagauggccagcaacgacgccaaccccagcgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagaccaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagcccggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22151 - RNA, 1623 nt, Artificial Sequence; identical to SEQ ID NO: 22065
  derived and/or modified sequence opt4 from capsid_protein_VP1__Norovirus__AGE89499

SEQ ID NO: 22152 - RNA, 1623 nt, Artificial Sequence
  derived and/or modified sequence opt4 from capsid_protein_VP1__Norovirus__AGE89502
augaagauggccagcaacgacgccaaccccagcgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagaccaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcgccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22153 - RNA, 1623 nt, Artificial Sequence; identical to SEQ ID NO: 22065
  derived and/or modified sequence opt4 from capsid_protein_VP1__Norovirus__AGE89505

SEQ ID NO: 22154 - RNA, 1623 nt, Artificial Sequence
  derived and/or modified sequence opt4 from capsid_protein_VP1__Norovirus__AGE89508
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagagacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgaggcccaccagaacaccaaguucacccccgugggcgugauccaggacggcggcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22155 - RNA, 1623 nt, Artificial Sequence; identical to SEQ ID NO: 22065
  derived and/or modified sequence opt4 from capsid_protein_VP1__Norovirus__AGE89511

SEQ ID NO: 22156 - RNA, 1623 nt, Artificial Sequence; identical to SEQ ID NO: 22065
  derived and/or modified sequence opt4 from capsid_protein_VP1__Norovirus__AGE89514

SEQ ID NO: 22157 - RNA, 1623 nt, Artificial Sequence; identical to SEQ ID NO: 22065
  derived and/or modified sequence opt4 from capsid_protein_VP1__Norovirus__AGE89517

SEQ ID NO: 22158 - RNA, 1623 nt, Artificial Sequence; identical to SEQ ID NO: 22152
  derived and/or modified sequence opt4 from capsid_protein_VP1__Norovirus__AGE89520

SEQ ID NO: 22159 - RNA, 1623 nt, Artificial Sequence; identical to SEQ ID NO: 22065
  derived and/or modified sequence opt4 from capsid_protein_VP1__Norovirus__AGE89523

SEQ ID NO: 22160 - RNA, 1623 nt, Artificial Sequence; identical to SEQ ID NO: 22065
  derived and/or modified sequence opt4 from capsid_protein_VP1__Norovirus__AGE89526

SEQ ID NO: 22161 - RNA, 1623 nt, Artificial Sequence; identical to SEQ ID NO: 22147
  derived and/or modified sequence opt4 from capsid_protein_VP1__Norovirus__AGE89529

SEQ ID NO: 22162 - RNA, 1623 nt, Artificial Sequence; identical to SEQ ID NO: 22065
  derived and/or modified sequence opt4 from capsid_protein_VP1__Norovirus__AGE89532

SEQ ID NO: 22163 - RNA, 1623 nt, Artificial Sequence; identical to SEQ ID NO: 22115
  derived and/or modified sequence opt4 from capsid_protein_VP1__Norovirus__AGE89535

SEQ ID NO: 22164 - RNA, 1623 nt, Artificial Sequence
  derived and/or modified sequence opt4 from capsid_protein_VP1__Norovirus__AGE89538
augaagauggccagcaacgacgccaaccccagcgacggcagcgccgccagccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagaccaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacgccgcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22165 - RNA, 1623 nt, Artificial Sequence; identical to SEQ ID NO: 22065
  derived and/or modified sequence opt4 from capsid_protein_VP1__Norovirus__AGE89541

SEQ ID NO: 22166 - RNA, 1623 nt, Artificial Sequence; identical to SEQ ID NO: 22065
  derived and/or modified sequence opt4 from capsid_protein_VP1__Norovirus__AGE89544

SEQ ID NO: 22167 - RNA, 1623 nt, Artificial Sequence; identical to SEQ ID NO: 22119
  derived and/or modified sequence opt4 from capsid_protein_VP1__Norovirus__AGE89547

SEQ ID NO: 22168 - RNA, 1623 nt, Artificial Sequence; identical to SEQ ID NO: 22098
  derived and/or modified sequence opt4 from capsid_protein_VP1__Norovirus__AGE89550

SEQ ID NO: 22169 - RNA, 1623 nt, Artificial Sequence
  derived and/or modified sequence opt4 from capsid_protein_VP1__Norovirus__AGE89553
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgaggcccaccagaacaccaaguucacccccgugggcgugauccaggacggcggcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22170 - RNA, 1623 nt, Artificial Sequence; identical to SEQ ID NO: 22147
  derived and/or modified sequence opt4 from capsid_protein_VP1__Norovirus__AGE89556

SEQ ID NO: 22171 - RNA, 1623 nt, Artificial Sequence
  derived and/or modified sequence opt4 from capsid_protein_VP1__Norovirus__AGE89559
augaagauggccagcaacgacgccaaccccagcgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagaccaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaaggaggacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagagacgugcacaacgugcaccuggcccccgccguggcccccaccuuccccggcgagcagauccuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22172 - RNA, 1623 nt, Artificial Sequence
  derived and/or modified sequence opt4 from capsid_protein_VP1__Norovirus__AGE89562
augaagauggccagcaacgacgccaaccccagcgacggcagcgccgccagccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagaccaacgaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22173 - RNA, 1623 nt, Artificial Sequence
  derived and/or modified sequence opt4 from capsid_protein_VP1__Norovirus__AGE89565
augaagauggccagcaacgacgccaaccccagcgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagaccaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagacccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22174 - RNA, 1623 nt, Artificial Sequence; identical to SEQ ID NO: 22065
  derived and/or modified sequence opt4 from capsid_protein_VP1__Norovirus__AGE89568

SEQ ID NO: 22175 - RNA, 1623 nt, Artificial Sequence; identical to SEQ ID NO: 22065
  derived and/or modified sequence opt4 from capsid_protein_VP1__Norovirus__AGE89571

SEQ ID NO: 22176 - RNA, 1623 nt, Artificial Sequence; identical to SEQ ID NO: 22065
  derived and/or modified sequence opt4 from capsid_protein_VP1__Norovirus__AGE89574

SEQ ID NO: 22177 - RNA, 1623 nt, Artificial Sequence; identical to SEQ ID NO: 22065
  derived and/or modified sequence opt4 from capsid_protein_VP1__Norovirus__AGE89577

SEQ ID NO: 22178 - RNA, 1623 nt, Artificial Sequence; identical to SEQ ID NO: 22098
  derived and/or modified sequence opt4 from capsid_protein_VP1__Norovirus__AGE89580

SEQ ID NO: 22179 - RNA, 1623 nt, Artificial Sequence; identical to SEQ ID NO: 22065
  derived and/or modified sequence opt4 from capsid_protein_VP1__Norovirus__AGE89583

SEQ ID NO: 22180 - RNA, 1623 nt, Artificial Sequence
  derived and/or modified sequence opt4 from capsid_protein_VP1__Norovirus__AGE89586
augaagauggccagcaacgacgccaaccccagcgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagaccaacgaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggaggugcccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22181 - RNA, 1623 nt, Artificial Sequence; identical to SEQ ID NO: 22065
  derived and/or modified sequence opt4 from capsid_protein_VP1__Norovirus__AGE89589

SEQ ID NO: 22182 - RNA, 1623 nt, Artificial Sequence; identical to SEQ ID NO: 22065
  derived and/or modified sequence opt4 from capsid_protein_VP1__Norovirus__AGE89592

SEQ ID NO: 22183 - RNA, 1623 nt, Artificial Sequence; identical to SEQ ID NO: 22112
  derived and/or modified sequence opt4 from capsid_protein_VP1__Norovirus__AGE89595

SEQ ID NO: 22184 - RNA, 1623 nt, Artificial Sequence
  derived and/or modified sequence opt4 from capsid_protein_VP1__Norovirus__AGE89598
augaagauggccagcaacgacgccaaccccagcgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagaccaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagagacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22185 - RNA, 1623 nt, Artificial Sequence; identical to SEQ ID NO: 22065
  derived and/or modified sequence opt4 from capsid_protein_VP1__Norovirus__AGE89601

SEQ ID NO: 22186 - RNA, 1623 nt, Artificial Sequence; identical to SEQ ID NO: 22065
  derived and/or modified sequence opt4 from capsid_protein_VP1__Norovirus__AGE89604

SEQ ID NO: 22187 - RNA, 1623 nt, Artificial Sequence; identical to SEQ ID NO: 22065
  derived and/or modified sequence opt4 from capsid_protein_VP1__Norovirus__AGE89607

SEQ ID NO: 22188 - RNA, 1623 nt, Artificial Sequence; identical to SEQ ID NO: 22065
  derived and/or modified sequence opt4 from capsid_protein_VP1__Norovirus__AGE89610

SEQ ID NO: 22189 - RNA, 1623 nt, Artificial Sequence; identical to SEQ ID NO: 22098
  derived and/or modified sequence opt4 from capsid_protein_VP1__Norovirus__AGE89613

SEQ ID NO: 22190 - RNA, 1623 nt, Artificial Sequence
  derived and/or modified sequence opt4 from capsid_protein_VP1__Norovirus__AGE89616
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcaacgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22191 - RNA, 1623 nt, Artificial Sequence; identical to SEQ ID NO: 22112
  derived and/or modified sequence opt4 from capsid_protein_VP1__Norovirus__AGE89622

SEQ ID NO: 22192 - RNA, 1623 nt, Artificial Sequence
  derived and/or modified sequence opt4 from capsid_protein_VP1__Norovirus__AGE89625
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaucaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22193 - RNA, 1623 nt, Artificial Sequence
  derived and/or modified sequence opt4 from capsid_protein_VP1__Norovirus__AGE89628
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcggcaccacccacagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22194 - RNA, 1623 nt, Artificial Sequence; identical to SEQ ID NO: 22065
  derived and/or modified sequence opt4 from capsid_protein_VP1__Norovirus__AGE89631

SEQ ID NO: 22195 - RNA, 1623 nt, Artificial Sequence; identical to SEQ ID NO: 22119
  derived and/or modified sequence opt4 from capsid_protein_VP1__Norovirus__AGE89634

SEQ ID NO: 22196 - RNA, 1623 nt, Artificial Sequence; identical to SEQ ID NO: 22065
  derived and/or modified sequence opt4 from capsid_protein_VP1__Norovirus__AGE89637

SEQ ID NO: 22197 - RNA, 1623 nt, Artificial Sequence; identical to SEQ ID NO: 22065
  derived and/or modified sequence opt4 from capsid_protein_VP1__Norovirus__AGE89640

SEQ ID NO: 22198 - RNA, 1623 nt, Artificial Sequence
  derived and/or modified sequence opt4 from capsid_protein_VP1__Norovirus__AGE89643
augaagauggccagcaacgacgccaaccccagcgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagaccaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcaguggaugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22199 - RNA, 1623 nt, Artificial Sequence; identical to SEQ ID NO: 22065
  derived and/or modified sequence opt4 from capsid_protein_VP1__Norovirus__AGE89646

SEQ ID NO: 22200 - RNA, 1623 nt, Artificial Sequence
  derived and/or modified sequence opt4 from capsid_protein_VP1__Norovirus__AGE89649
augaagauggccagcaacgacgccaaccccagcgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagaccaacgaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22201 - RNA, 1623 nt, Artificial Sequence
  derived and/or modified sequence opt4 from capsid_protein_VP1__Norovirus__AGE89652
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcagguggugcuggccggcaacgccuucaccgccggcaagaucaucuucgccgccgugccccccaacuuccccaccgagggccugagccccagccaggugaccauguucccccacaugaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagccacaacuacaccaugaaccuggccacccagaacuggaacagcuacgaccccaccgaggagauccccgccccccugggcacccccgacuucgugggcaagauccagggcgugcugacccagaccaccagagccgacggcagcaccagaggccacaaggccaccguguacaccggcagcgccgacuucgcccccaagcugggcagagugcaguucgccaccgacaccaacaacgaccugggcgccaaccagaacaccaaguucacccccgugggcgugauccaggacggcggcaccgcccacagaaacgagccccagcagugggugcugcccagcuacagcggcagaaacagccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22202 - RNA, 1623 nt, Artificial Sequence; identical to SEQ ID NO: 22065
  derived and/or modified sequence opt4 from capsid_protein_VP1__Norovirus__AGE89655

SEQ ID NO: 22203 - RNA, 1623 nt, Artificial Sequence; identical to SEQ ID NO: 22065
  derived and/or modified sequence opt4 from capsid_protein_VP1__Norovirus__AGE89658

SEQ ID NO: 22204 - RNA, 1623 nt, Artificial Sequence; identical to SEQ ID NO: 22065
  derived and/or modified sequence opt4 from capsid_protein_VP1__Norovirus__AGE89661

SEQ ID NO: 22205 - RNA, 1623 nt, Artificial Sequence
  derived and/or modified sequence opt4 from capsid_protein_VP1__Norovirus__AGE89664
augaagauggccagcaacgacgccaaccccagcgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagaccaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgaggacgacuucgagacccaccagaacaccaaguucacccccgugggcgugauccaggacggcggcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22206 - RNA, 1623 nt, Artificial Sequence; identical to SEQ ID NO: 22065
  derived and/or modified sequence opt4 from capsid_protein_VP1__Norovirus__AGE89667

SEQ ID NO: 22207 - RNA, 1623 nt, Artificial Sequence; identical to SEQ ID NO: 22065
  derived and/or modified sequence opt4 from capsid_protein_VP1__Norovirus__AGE89673

SEQ ID NO: 22208 - RNA, 1623 nt, Artificial Sequence
  derived and/or modified sequence opt4 from capsid_protein_VP1__Norovirus__AGE99603
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaagcaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcagaugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgccgacuucacccccaagcugggcagcgugcaguucggcaccgacaccgacaacgacuucgagacccaccagaacaccagauucacccccgugggcgugauccaggacggcgccaccacccacagaaacgagccccagcagugggugcugcccagcuacagcggcagaaacgugcacaacgugcaccuggcccccgccguggcccccaacuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22209 - RNA, 1623 nt, Artificial Sequence
  derived and/or modified sequence opt4 from capsid_protein_VP1__Norovirus__AGI17592
augaugauggccagcaacgacgccgcccccagcaacgacggcgccaccggccuggugcccgagaucaaccacgagacccugccccuggagcccguggccggcgccgccaucgccgcccccgugaccggccagaacaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacaacaaccagcccgccaacagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucagccugcccauccugaccaucagcgagcugaccaacagcagauuccccgcccccaucgacagccuguacaccgcccagaacaacaaccugaacgugcagugccagaacggcagaugcacccuggacggcgagcugcagggcaccacccagcugcugcccagcggcaucugcgccuucagaggcaagcugaccgccgacgugcaccagagccacgacgacagauggcacaugcagcugaccaaccugaacggcacccccuucgaccccaccgaggacgugcccgccccccugggcacccccgacuucaccggccugcuguucggcguggccagccagagaaacguggugagcaaccccaacaccaccagagcccacgaggccgugaucagcaccaccagcagccaguucgugcccaagcugggcagcaucaacuucggcagcaccagcgacgacuuccagcugcagcagcccaccaaguucacccccgugggcaucaagguggagagcggccacgacuucgaccagugggcccugcccagauacagcggccaccugacccugaacaugaaccuggccccccccguggcccccaacuuccccggcgagcagcugcuguucuucagaagcaacgugcccugcgccggcggcgugagcgacggcgugaucgacugccugcugccccaggaguggauccaguacuucuaccaggagagcgcccccagccagagcgacguggcccugaucagauacgugaaccccgacaccggcagaacccuguucgaggccaagcugcacagaaccggcuacaucaccguggcccacagcggcgacuacccccugguggugcccagcaacggcuacuucagauucgacagcugggugaaccaguucuacagccuggcccccaugggcaccggcaacggcagaagaagagugcaguga

SEQ ID NO: 22210 - RNA, 1650 nt, Artificial Sequence
  derived and/or modified sequence opt4 from capsid_protein_VP1__Norovirus__AGI17594
augaagauggccagcaacgacgccgcccccagcaacgacggcgccgccggccuggugcccgagaucaacagcgaggccauggcccuggagcccguggccggcgccgccaucgccgccccccugaccggccagcagaacaucaucgaccccuggaucaugaacaacuucgugcaggcccccggcggcgaguucaccaucagccccagaaacggccccggcgaggugcugcugaaccuggagcugggccccgagaucaaccccuaccuggcccaccuggccagaauguacaacggcuacgccggcggcuucgaggugcagguggugcuggccggcaacgccuucaccgccggcaagaucaucuucgccgccaucccccccaacuuccccaucgacaaccugagcgccgcccaggugaccaugugcccccacgugaucguggacgugagacagcuggagcccgugaaccugcccaugcccgacgugagaaacagcuucuuccacuacaaccagggcaccgacagcagacugagacugaucgccaugcuguacaccccccugagagccaacaacagcggcgacgacguguucaccgugagcugcagagugcugaccagacccagccccgacuucagcuucaacuuccuggugccccccaccguggagagcaagaccaagcccuucacccugcccauccugaccaucagcgagaugagcaacagcagauuccccgugcccaucgacagccugcacaccagccccaccgacaacaucguggugcagugccagaacggcagagugacccuggacggcgagcugaugggcaccacccagcugcugcccagccagaucugcgccuucagaggcgugcugacccagagaaccagcagagccagcgaccaggccgacaccgccgugacccccagagccuucgaccacagauggcacauccagcuggacaaccugaacggcacccacuacgaccccagcgaggacauccccggcccccugggcauccccgacuucagaggcagaguguacggcguggccagccagagaaacagcgacggcagcaccagagcccacgaggccaagaucgacaccaccagcagcagauucacccccaagcugggcagccuggagaucagcaccgagagcgacgacuucgacgagaacaagcccaccagauucacccccgugggcaucggcguggacaacgagagagaguuccagcaguggagccugcccgacuacagcggccaguucacccacaacaugcaccuggcccccgccguggcccccaacuuccccggcgagcagcugcuguucuucagaagccaccugcccagcagcggcggcuggguggacggcacccuggacugccugcugccccaggaguggauccagcacuucuaccaggagagcgcccccagccagacccagguggcccuggugagauacgugaaccccgacaccggcagagugcuguucgaggccaagcugcacaagagcggcuucaugaccaucgccagaagcggcgacagccccaucaccgugccccccaacggcuacuucagauucgagagcugggugaaccccuucuacacccuggcccccaugggcaccggcaacggcagaagaagaauccaguga

SEQ ID NO: 22211 - RNA, 1623 nt, Artificial Sequence
  derived and/or modified sequence opt4 from capsid_protein_VP1__Norovirus__AGK36311
augaagauggccagcaacgacgccaaccccagcgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugagagugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagaccaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagauccaccagaacaccaaguucacccccgugggcgugauccaggacggcggcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22212 - RNA, 1623 nt, Artificial Sequence; identical to SEQ ID NO: 22112
  derived and/or modified sequence opt4 from capsid_protein_VP1__Norovirus__AGK36314

SEQ ID NO: 22213 - RNA, 1593 nt, Artificial Sequence
  derived and/or modified sequence opt4 from capsid_protein_VP1__Norovirus__AGM33208
augaugauggccagcaaggacgccaccagcagcguggacggcgccagcggcgccggccagcuggugcccgaggugaacgccagcgacccccuggccauggaccccguggccggcagcagcaccgccguggccaccgccggccaggugaaccccaucgaccccuggaucaucaacaacuucgugcaggccccccagggcgaguucaccaucagccccaacaacacccccggcgacgugcuguucgaccugagccugggcccccaccugaaccccuuccugcugcaccugagccagauguacaacggcugggugggcaacaugagagugagaaucaugcuggccggcaacgccuucaccgccggcaagaucaucgugagcugcaucccccccggcuucggcagccacaaccugaccaucgcccaggccacccuguucccccacgugaucgccgacgugagaacccuggaccccaucgaggugccccuggaggacgugagaaacgugcuguuccacaacaacgacagaaaccagcagaccaugagacuggugugcaugcuguacaccccccugagaaccggcggcggcaccggcgacagcuucgugguggccggcagagugaugaccugccccagccccgacuucaacuuccuguuccuggugccccccaccguggagcagaagaccagacccuucacccugcccaaccugccccugagcagccugagcaacagcagagccccccugcccaucagcagcaugggcaucagccccgacaacgugcagagcgugcaguuccagaacggcagaugcacccuggacggcagacuggugggcaccacccccgugagccugagccacguggccaagaucagaggcaccagcaacggcaccgugaucaaccugaccgagcuggacggcacccccuuccaccccuucgagggccccgcccccaucggcuuccccgaccugggcggcugcgacuggcacaucaacaugacccaguucggccacagcagccagacccaguacgacguggacaccacccccgacaccuucgugccccaccugggcagcauccaggccaacggcaucggcagcggcaacuacgugggcgugcugagcuggaucagcccccccagccaccccagcggcagccagguggaccuguggaagauccccaacuacggcagcagcaucaccgaggccacccaccuggcccccagcguguacccccccggcuucggcgaggugcugguguucuucaugagcaagaugcccggccccggcgccuacaaccugcccugccugcugccccaggaguacaucagccaccuggccagcgagcaggcccccaccgugggcgaggccgcccugcugcacuacguggaccccgacaccggcagaaaccugggcgaguucaaggccuaccccgacggcuuccugaccugcgugcccaacggcgccagcagcggcccccagcagcugcccaucaacggcguguucguguucgugagcugggugagcagauucuaccagcugaagcccgugggcaccgccagcagcgccagaggcagacugggccugagaagauga

SEQ ID NO: 22214 - RNA, 1593 nt, Artificial Sequence
  derived and/or modified sequence opt4 from capsid_protein_VP1__Norovirus__AGM33214
augaugauggccagcaaggacgccaccagcagcguggacggcgccagcggcgccggccagcuggugcccgaggugaacgccagcgacccccuggccauggaccccguggccggcagcagcaccgccguggccaccgccggccaggugaaccccaucgaccccuggaucaucaacaacuucgugcaggccccccagggcgaguucaccaucagccccaacaacacccccggcgacgugcuguucgaccugagccugggcccccaccugaaccccuuccugcugcaccugagccagauguacaacggcugggugggcaacaugagagugagaaucaugcuggccggcaacgccuucaccgccggcaagaucaucgugagcugcaucccccccggcuucggcagccacaaccugaccaucgcccaggccacccuguucccccacgugaucgccgacgugagaacccuggaccccaucgaggugccccuggaggacgugagaaacgugcuguuccacaacaacgacagaaaccagcagaccaugagacuggugugcaugcuguacaccccccugagaaccggcggcggcaccggcgacagcuucgugguggccggcagagugaugaccugccccagccccgacuucaacuuccuguuccuggugccccccaccguggagcagaagaccagacccuucacccugcccaaccugccccugagcagccugagcaacagcagagccccccugcccaucagcagcaugggcaucagccccgacaacgugcagagcgugcaguuccagaacggcagaugcacccuggacggcagacuggugggcaccacccccgugagccugagccacguggccaagaucagaggcaccagcaacggcaccgugaucaaccugaccgagcuggacggcacccccuuccaccccuucgagggccccgcccccaucggcuuccccgaccugggcggcugcgacuggcacaucaacaugacccaguucggccacagcagccagacccaguacgacgugaacaccacccccgacaccuucgugccccaccugggcagcauccaggccaacggcaucggcagcggcaacuacgugggcgugcugagcuggaucagcccccccagccaccccagcggcagccagguggaccuguggaagauccccaacuacggcagcagcaucaccgaggccacccaccuggcccccagcguguacccccccggcuucggcgaggugcugguguucuucaugagcaagaugcccggccccggcgccuacaaccugcccugccugcugccccaggaguacaucagccaccuggccagcgagcaggcccccaccgugggcgaggccgcccugcugcacuacguggaccccgacaccggcagaaaccugggcgaguucaaggccuaccccgacggcuuccugaccugcgugcccaacggcgccagcagcggcccccagcagcugcccaucaacggcguguucguguucgugagcugggugagcagauucuaccagcugaagcccgugggcaccgccagcagcgccagaggcagacugggccugagaagauga

SEQ ID NO: 22215 - RNA, 1593 nt, Artificial Sequence; identical to SEQ ID NO: 22213
  derived and/or modified sequence opt4 from capsid_protein_VP1__Norovirus__AGM33217

SEQ ID NO: 22216 - RNA, 1593 nt, Artificial Sequence
  derived and/or modified sequence opt4 from capsid_protein_VP1__Norovirus__AGM33220
augaugauggccagcaaggacgccaccagcagcguggacggcgccagcggcgccggccagcuggugcccgaggugaacgccagcgacccccuggccauggaccccguggccggcagcagcaccgccguggccaccgccggccaggugaaccccaucgaccccuggaucaucaacaacuucgugcaggccccccagggcgaguucaccaucagccccaacaacacccccggcgacgugcuguucgaccugagccugggcccccaccugaaccccuuccugcugcaccugagccagauguacaacggcugggugggcaacaugagagugagaaucaugcuggccggcaacgccuucaccgccggcaagaucaucgugagcugcaucccccccggcuucggcagccacaaccugaccaucgcccaggccacccuguucccccacgugaucgccgacgugagaacccuggaccccaucgaggugccccuggaggacgugagaaacgugcuguuccacaacaacgacagaaaccagcagaccaugagacuggugugcaugcuguacaccccccugagaaccggcggcggcaccggcgacagcuucgugguggccggcagagugaugaccugccccagccccgacuucaacuuccuguuccuggugccccccaccguggagcagaagaccagacccuucacccugcccaaccugccccugagcagccugagcaacagcagagccccccugcccaucagcagcaugggcaucagccccgacaacgugcagagcgugcaguuccagaacggcagaugcacccuggacggcagacuggugggcaccacccccgugagccugagccacguggccaagaucagaggcaccagcaacggcaccgugaucaaccugaccgagcuggacggcacccccuuccaccccuucgagggccccgcccccaucggcuuccccgaccugggcggcugcgacuggcacaucaacaugacccaguucggccacagcagccagacccaguacgacguggacaccacccccgacaccuucgugccccaccugggcagcauccaggccaacggcgugggcagcggcaacuacgugggcgugcugagcuggaucagcccccccagccaccccagcggcagccagguggaccuguggaagauccccaacuacggcagcagcaucaccgaggccacccaccuggcccccagcguguacccccccggcuucggcgaggugcugguguucuucaugagcaagaugcccggccccggcgccuacaaccugcccugccugcugccccaggaguacaucagccaccuggccagcgagcaggcccccaccgugggcgaggccgcccugcugcacuacguggaccccgacaccggcagaaaccugggcgaguucaaggccuaccccgacggcuuccugaccugcgugcccaacggcgccagcagcggcccccagcagcugcccaucaacggcguguucguguucgugagcugggugagcagauucuaccagcugaagcccgugggcaccgccagcagcgccagaggcagacugggccugagaagauga

SEQ ID NO: 22217 - RNA, 1593 nt, Artificial Sequence
  derived and/or modified sequence opt4 from capsid_protein_VP1__Norovirus__AGM33226
augaugauggccagcaaggacgccaccagcagcguggacggcgccagcggcgccggccagcuggugcccgaggugaacgccagcgacccccuggccauggaccccguggccggcagcagcaccgccguggccaccgccggccaggugaaccccaucgaccccuggaucaucaacaacuucgugcaggccccccagggcgaguucaccaucagccccaacaacacccccggcgacgugcuguucgaccugagccugggcccccaccugaaccccuuccugcugcaccugagccagauguacaacggcugggugggcaacaugagagugagaaucaugcuggccggcaacgccuucaccgccggcaagaucaucgugagcugcaucccccccggcuucggcagccacaaccugaccaucgcccaggccacccuguucccccacgugaucgccgacgugagaacccuggaccccaucgaggugccccuggaggacgugagaaacgugcuguuccacaacaacgacagaaaccagcagaccaugagacuggugugcaugcuguacaccccccugagaaccggcggcggcaccggcgacagcuucgugguggccggcagagugaugaccugccccagccccgacuucaacuuccuguuccuggugccccccaccguggagcagaagaccagacccuucacccugcccaaccugccccugagcagccugagcaacagcagagccccccugcccaucagcagcaugggcaucagccccgacaacgugcagagcgugcaguuccagaacggcagaugcacccuggacggcagacuggugggcaccacccccgugagccugagccacguggccaagaucagaggcaccagcaacggcaccgugaucaaccugaccgagcuggacggcacccccuuccaccccuucgagggccccgcccccaucggcuuccccgaccugggcggcugcgacuggcacaucaacaugacccaguucggccacagcagccagacccaguacgacguggacaccacccccgacaucuucgugccccaccugggcagcauccaggccaacggcaucggcagcggcaacuacgugggcgugcugagcuggaucagcccccccagccaccccagcggcagccagguggaccuguggaagauccccaacuacggcagcagcaucaccgaggccacccaccuggcccccagcguguacccccccggcuucggcgaggugcugguguucuucaugagcaagaugcccggccccggcgccuacaaccugcccugccugcugccccaggaguacaucagccaccuggccagcgagcaggcccccaccgugggcgaggccgcccugcugcacuacguggaccccgacaccggcagaaaccugggcgaguucaaggccuaccccgacggcuuccugaccugcgugcccaacggcgccagcagcggcccccagcagcugcccaucaacggcguguucguguucgugagcugggugagcagauucuaccagcugaagcccgugggcaccgccagcagcgccagaggcagacugggccugagaagauga

SEQ ID NO: 22218 - RNA, 1593 nt, Artificial Sequence
  derived and/or modified sequence opt4 from capsid_protein_VP1__Norovirus__AGM33229
augaugauggccagcaaggacgccaccagcagcguggacggcgccagcggcgccggccagcuggugcccgaggugaacgccagcgacccccuggccauggaccccguggccggcagcagcaccgccguggccaccgccggccaggugaaccccaucgaccccuggaucaucaacaacuucgugcaggccccccagggcgaguucaccaucagccccaacaacacccccggcgacgugcuguucgaccugagccugggcccccaccugaaccccuuccugcugcaccugagccagauguacaacggcugggugggcaacaugagagugagaaucaugcuggccggcaacgccuucaccgccggcaagaucaucgugagcugcaucccccccggcuucggcagccacaaccugaccaucgcccaggccacccuguucccccacgugaucgccgacgugagaacccuggaccccaucgaggugccccuggaggacgugagaaacgugcuguuccacaacaacgacagaaaccagcagaccaugagacuggugugcaugcuguacaccccccugagaaccggcggcggcaccggcgacagcuucgugguggccggcagagugaugaccugccccagccccgacuucaacuuccuguuccuggugccccccaccguggagcagaagaccagacccuucacccugcccaaccugccccugagcagccugagcaacagcagagccccccugcccaucagcagcaugggcaucagccccgacaacgugcagagcgugcaguuccagaacggcagaugcacccuggacggcagacuggugggcaccacccccgugagccugagccacguggccaagaucagaggcaccagcaacggcaccgugaucaaccugaccgagcuggacggcacccccuuccaccccuucgagggccccgcccccaucggcuuccccgaccugggcggcugcgacuggcacaucaacaugacccaguucggccacagcagccagacccaguacgacguggacaccacccccgugaccuucgugccccaccugggcagcauccaggccaacggcaucggcagcggcaacuacgugggcgugcugagcuggaucagcccccccagccaccccagcggcagccagguggaccuguggaagauccccaacuacggcagcagcaucaccgaggccacccaccuggcccccagcguguacccccccggcuucggcgaggugcugguguucuucaugagcaagaugcccggccccggcgccuacaaccugcccugccugcugccccaggaguacaucagccaccuggccagcgagcaggcccccaccgugggcgaggccgcccugcugcacuacguggaccccgacaccggcagaaaccugggcgaguucaaggccuaccccgacggcuuccugaccugcgugcccaacggcgccagcagcggcccccagcagcugcccaucaacggcguguucguguucgugagcugggugagcagauucuaccagcugaagcccgugggcaccgccagcagcgccagaggcagacugggccugagaagauga

SEQ ID NO: 22219 - RNA, 1593 nt, Artificial Sequence
  derived and/or modified sequence opt4 from capsid_protein_VP1__Norovirus__AGM33232
augaugauggccagcaaggacgccaccagcagcguggacggcgccagcggcgccggccagcuggugcccgaggugaacgccagcgacccccuggccauggaccccguggccggcagcagcaccgccguggccaccgccggccaggugaaccccaucgaccccuggaucaucaacaacuucgugcaggccccccagggcgaguucaccaucagccccaacaacacccccggcgacgugcuguucgaccugagccugggcccccaccugaaccccuuccugcugcaccugagccagauguacaacggcugggugggcaacaugagagugagaaucaugcuggccggcaacgccuucaccgccggcaagaucaucgugagcugcaucccccccggcuucggcagccacaaccugaccaucgcccaggccacccuguucccccacgugaucgccgacgugagaacccuggaccccaucgaggugccccuggaggacgugagaaacgugcuguuccacaacaacgacagaaaccagcagaccaugagacuggugugcaugcuguacaccccccugagaaccggcggcggcaccggcgacagcuucgugguggccggcagagugaugaccugccccagccccgacuucaacuuccuguuccuggugccccccaccguggagcagaagaccagacccuucacccugcccaaccugccccugagcagccugagcaacagcagagccccccugcccaucagcagcaugggcaucagccccgacaacgugcagagcgugcaguuccagaacggcagaugcacccuggacggcagacuggugggcaccacccccgugagccugagccacguggccaagaucagaggcaccagcaacggcaccgugaucaaccugaccgagcuggacggcacccccuuccaccccuucgagggccccgcccccaucggcuuccccgaccugggcggcugcgacuggcacaucaacaugacccaguucggccacagcagccagacccaguacgacguggacaccacccccgacaccuucgugccccaccugggcagcauccaggccaacggcaucggcagcggcaacuacgugggcgugcugagcuggaucagcccccccagcagacccagcggcagccagguggaccuguggaagauccccaacuacggcagcagcaucaccgaggccacccaccuggcccccagcguguacccccccggcuucggcgaggugcugguguucuucaugagcaagaugcccggccccggcgccuacaaccugcccugccugcugccccaggaguacaucagccaccuggccagcgagcaggcccccaccgugggcgaggccgcccugcugcacuacguggaccccgacaccggcagaaaccugggcgaguucaaggccuaccccgacggcuuccugaccugcgugcccaacggcgccagcagcggcccccagcagcugcccaucaacggcguguucguguucgugagcugggugagcagauucuaccagcugaagcccgugggcaccgccagcagcgccagaggcagacugggccugagaagauga

SEQ ID NO: 22220 - RNA, 1593 nt, Artificial Sequence; identical to SEQ ID NO: 22219
  derived and/or modified sequence opt4 from capsid_protein_VP1__Norovirus__AGM33235

SEQ ID NO: 22221 - RNA, 1593 nt, Artificial Sequence
  derived and/or modified sequence opt4 from capsid_protein_VP1__Norovirus__AGM33238
augaugauggccagcaaggacgccaccagcagcguggacggcgccagcggcgccggccagcuggugcccgaggugaacgccagcgacccccuggccauggaccccguggccggcagcagcaccgccguggccaccaccggccaggugaaccccaucgaccccuggaucaucaacaacuucgugcaggccccccagggcgaguucaccaucagccccaacaacacccccggcgacgugcuguucgaccugagccugggcccccaccugaaccccuuccugcugcaccugagccagauguacaacggcugggugggcaacaugagagugagaaucaugcuggccggcaacgccuucaccgccggcaagaucaucgugagcugcaucccccccggcuucggcagccacaaccugaccaucgcccaggccacccuguucccccacgugaucgccgacgugagaacccuggaccccaucgaggugccccuggaggacgugagaaacgugcuguuccacaacaacgacagaaaccagcagaccaugagacuggugugcaugcuguacaccccccugagaaccggcggcggcaccggcgacagcuucgugguggccggcagagugaugaccugccccagccccgacuucaacuuccuguuccuggugccccccaccguggagcagaagaccagacccuucacccugcccaaccugccccugagcagccugagcaacagcagagccccccugcccaucagcagcaugggcaucagccccgacaacgugcagagcgugcaguuccagaacggcagaugcacccuggacggcagacuggugggcaccacccccgugagccugagccacguggccaagaucagaggcaccagcaacggcaccgugaucaaccugaccgagcuggacggcacccccuuccaccccuucgagggccccgcccccaucggcuuccccgaccugggcggcugcgacuggcacaucaacaugacccaguucggccacagcagccagacccaguacgacguggacaccacccccgacaccuucgugccccaccugggcagcauccaggccaacggcaucggcagcggcaacuacgugggcgugcugagcuggaucagcccccccagccaccccagcggcagccagguggaccuguggaagauccccaacuacggcagcagcaucaccgaggccacccaccuggcccccagcguguacccccccggcuucggcgaggugcugguguucuucaugagcaagaugcccggccccggcgccuacaaccugcccugccugcugccccaggaguacaucagccaccuggccagcgagcaggcccccaccgugggcgaggccgcccugcugcacuacguggaccccgacaccggcagaaaccugggcgaguucaaggccuaccccgacggcuuccugaccugcgugcccaacggcgccagcagcggcccccagcagcugcccaucaacggcguguucguguucgugagcugggugagcagauucuaccagcugaagcccgugggcaccgccagcagcgccagaggcagacugggccugagaagauga

SEQ ID NO: 22222 - RNA, 1593 nt, Artificial Sequence; identical to SEQ ID NO: 22213
  derived and/or modified sequence opt4 from capsid_protein_VP1__Norovirus__AGM33241

SEQ ID NO: 22223 - RNA, 1593 nt, Artificial Sequence; identical to SEQ ID NO: 22214
  derived and/or modified sequence opt4 from capsid_protein_VP1__Norovirus__AGM33244

SEQ ID NO: 22224 - RNA, 1626 nt, Artificial Sequence
  derived and/or modified sequence opt4 from capsid_protein_VP1__Norovirus__AGO59890
augagaaugagcgacggcgccgcccccaaggccaacggcagcgaggccagcggccaggaccuggugcccgccgccguggagcaggccgugcccauccagcccguggccggcgccgcccuggccgcccccgccgccggccagaucaaccagaucgaccccuggaucuuccagaacuucgugcagugcccccugggcgaguucagcaucagccccagaaacacccccggcgagauccuguucgaccuggcccugggccccggccugaaccccuaccuggcccaccugagcgccauguacaccggcugggugggcaacauggaggugcagcuggugcuggccggcaacgccuucaccgccggcaagguggugguggcccuggugccccccuacuuccccaagggcagccugaccaccgcccagaucaccugcuucccccacgugaugugcgacgugagaacccuggagcccauccagcugccccugcuggacgugagaagagugcuguggcacgccacccaggaccaggaggagagcaugagacuggugugcaugcuguacaccccccugagaaccaacagccccggcgacgagagcuucguggugagcggcagacugcugagcaagcccgccgccgacuucaacuucguguaccugaccccccccaucgagagaaccaucuacagaaugguggaccugcccgugauccagcccagacugugcacccacgccagauggcccgcccccguguacggccugcugguggaccccagccugcccagcaacccccaguggcagaacggcagagugcacguggacggcacccugcugggcaccacccccaucagcggcagcugggugagcugcuucgccgccgaggccgccuacaaguuccagagcggcaucggcgagguggccaccuucacccugaucgagcaggacggcagcgccuacgugcccggcgacagagccgccccccugggcuaccccgacuucagcggccagcuggagaucgaggugcagaccgagaccaccaagaccggcgacaagcugaaggugaccaccuucgagaugauccugggccccaccaccaacgccgaccaggcccccuaccagggcagaguguucgccagcgugaccgccgccgccagccuggaccugguggacggcagagugagagccgugcccagaagcaucuacggcuuccaggacaccauccccgaguacaacgacggccugcuggugccccuggccccccccaucggccccuuccugcccggcgaggugcugcugagauucagaaccuacaugagacagaucgacaccgccgacgccgccgccgaggccaucgacugcgcccugccccaggaguucgugagcugguucgccagcaacgccuucaccgugcagagcgaggcccugcugcugagauacagaaacacccugaccggccagcugcuguucgagugcaagcuguacaacgagggcuacaucgcccugagcuacagcggcagcggcccccugaccuuccccaccgacggcaucuucgagguggugagcugggugcccagacuguaccagcuggccagcgugggcagccuggccaccggcagaaugcugaagcaguga

SEQ ID NO: 22225 - RNA, 1620 nt, Artificial Sequence
  derived and/or modified sequence opt4 from capsid_protein_VP1__Norovirus__AGT17782
augaagauggccagcaacgacgccacccccagcgacggcagcagcgccaaccuggugcccgaggugaacaacgaggugauggcccuggagcccguggccggcgccgccaucgccgcccccguggccggccagcagaacgugaucgaccccuggaucagaaacaacuucgugcaggcccccggcggcgaguucaccgugagccccagaaacgcccccggcgagauccuguggagcgccagccugggccccgaccugaaccccuaccugagccaccugagcagaauguacaacggcuacgccggcagcuucgaggugcaggugauccuggccggcaacgccuucaccgccggcaagaucaucuucgccgccgugccccccaacuucagaaccgagggccugagccccagccagaucaccauguucccccacaucaucaccgacgugagacagcuggagcccgugcugaucccccugcccgacaucagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugaccagaaucggcaacagcagagaguacagaaugaaccuggccagccugaacuggaacaacuacgaccccaccgaggagauccccgccccccugggcacccccgacuucgccggcaagauccagggcgugcugacccagaccaccagacacgacggcagcaccagaggccacaaggccaccguguacaccggcagcgccggcuucacccccaagcugggcagcgugcaguucagcaccgacaccgacaacgaccuggaggccaaccagaacaccagauucacccccgugggcgugauccaggacggcaacgcccaccagggcgagccccagcagugggugcugcccaacuacgccggcagagacggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggagagcgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcgccggcagaagaagagcccuguga

SEQ ID NO: 22226 - RNA, 1593 nt, Artificial Sequence; identical to SEQ ID NO: 22213
  derived and/or modified sequence opt4 from capsid_protein_VP1__Norovirus__AGT17785

SEQ ID NO: 22227 - RNA, 1623 nt, Artificial Sequence
  derived and/or modified sequence opt4 from capsid_protein_VP1__Norovirus__AGT17788
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcaccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgacgccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagccguguga

SEQ ID NO: 22228 - RNA, 1593 nt, Artificial Sequence; identical to SEQ ID NO: 22213
  derived and/or modified sequence opt4 from capsid_protein_VP1__Norovirus__AGT17792

SEQ ID NO: 22229 - RNA, 1623 nt, Artificial Sequence
  derived and/or modified sequence opt4 from capsid_protein_VP1__Norovirus__AGT17795
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgugaucaaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22230 - RNA, 1617 nt, Artificial Sequence
  derived and/or modified sequence opt4 from capsid_protein_VP1__Norovirus__AGT17798
augaagauggccagcagcgacgccaaccccagcgacggcagcaccgccaaccuggugcccgaggccaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgaggugcuguggagcgccccccugggccccgaccugaaccccuaccugagccaccuggccagaauguacaacggcuacgccggcggcuucgaggugcaggugauccuggccggcaacgccuucgccgccggcaagaucaucuucgccgccgugccccccaacuucagcaccgagggccugagccccagccaggugaccauguucccccaccugaucguggacgugagacagcuggagcccgugaugaucccccugcccgacaucagaaacaacuucuaccacuacaaccagagcaacgaccccaccaucaagcugaucgccaugcuguacaccccccugagagccaacaacgugggcgacgacguguucaccgugagcugcagagugcugaccagacccagccccgacuucgacuucaucuuccuggugccccccaccguggagagcaagaccaaccccuucagcgugcccauccugaccaucgaggagaugaccaacagcagauuccccaucccccuggagaagcuguucaccggccccagcagcgcccugguggugcagccccagaacggcagaugcaccaccgacggcgugcugcugggcaccacccagcugagccccgugaacaucugcaccuucagaggcgacgugacccacaccaccaagacccacaccuaccagaugaaccuggccgcccagaacuggaacagcuacgaccccaccgaggagacccccgccccccugggcacccccgacuucgugggcaagauccagggcgugcugacccagaccaccaagggcaacggcagcaccagagcccacaaggccaccguguacaccggcaccguggaguucacccccaagcugggcagaauccagcuguucaccgacaccgacaacgaccuggaggccaaccagaacaccaaguucacccccgugggcgugauccaggacggcgaccaccagaacgagccccagcagugggugcugcccagcuacagcggcagaaacaaccacaacgugcaccuggcccccgccguggcccccaccuuccccggcgagcagcugcuguucuucagaagcaccaugcccggcugcagcggcuaccccaacaugaaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccaccacgaccuggugaucccccccaacggcuacuucagauucgacagcugggugagccccuucuacacccuggcccccaugggcaacggcaccggcagaagaagagcccuguga

SEQ ID NO: 22231 - RNA, 1593 nt, Artificial Sequence; identical to SEQ ID NO: 22213
  derived and/or modified sequence opt4 from capsid_protein_VP1__Norovirus__AGT17803

SEQ ID NO: 22232 - RNA, 1593 nt, Artificial Sequence; identical to SEQ ID NO: 22213
  derived and/or modified sequence opt4 from capsid_protein_VP1__Norovirus__AGT17806

SEQ ID NO: 22233 - RNA, 1593 nt, Artificial Sequence; identical to SEQ ID NO: 22213
  derived and/or modified sequence opt4 from capsid_protein_VP1__Norovirus__AGT17809

SEQ ID NO: 22234 - RNA, 1623 nt, Artificial Sequence
  derived and/or modified sequence opt4 from capsid_protein_VP1__Norovirus__AGT17813
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcaccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgacgccaaccagaacaccaaguucacccccgugggcgugauccaggacggcggcaccgcccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagcccggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22235 - RNA, 1623 nt, Artificial Sequence
  derived and/or modified sequence opt4 from capsid_protein_VP1__Norovirus__AGT17816
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaagcaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggagcaacuacgaccccaccgaggagauccccgccccccugggcacccccgacuucgugggcaagauccagggcgugcugacccagaccaccaagggcgacggcagcaccagaggccacaaggccaccguguacaccggcagcgccgacuucacccccaagcugggcagcgugcaguucgccaccgacaccgagaacgacuucgagacccaccagaacaccagauucacccccgugggcgugauccaggacggcggcaccacccacagaaacgagccccagcagugggugcugcccagcuacagcggcagaaacgugcacaacgugcaccuggcccccgccguggcccccaacuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22236 - RNA, 1623 nt, Artificial Sequence
  derived and/or modified sequence opt4 from capsid_protein_VP1__Norovirus__AGT17819
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgugaccaaccagaacaccaaguucacccccgugggcgugauccaggacggcggcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22237 - RNA, 1623 nt, Artificial Sequence
  derived and/or modified sequence opt4 from capsid_protein_VP1__Norovirus__AGT17823
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagccccugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccaucgaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcacccacaacuacgccaugaaccuggccgcccagaacuggaacagcuacgaccccaccgaggagauccccgccccccugggcacccccgacuucgugggcaagauccagggcgugcugacccagaccaccagagccgacggcagcaccagagcccacaaggccaccguguacaccggcagcgccgaguucgcccccaagcugggcagagugcaguucgccaccgacaccgacagcgacuucgacaccaaccagaacaccaaguucacccccgugggcgugauccaggacggcaacaccgcccaccagaacgagccccagcagugggugcugcccagcuacagcggcagaaacaaccacaacgugcaccuggcccccgccguggcccccaccuuccccggcgagcagcugcuguucuucagaagcaccaugcccggcugcagcggcuaccccaacaugaaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugagccccuucuacacccuggcccccaugggcaacggcaccggcagaagaagagcccuguga

SEQ ID NO: 22238 - RNA, 1593 nt, Artificial Sequence; identical to SEQ ID NO: 22213
  derived and/or modified sequence opt4 from capsid_protein_VP1__Norovirus__AGT17826

SEQ ID NO: 22239 - RNA, 1620 nt, Artificial Sequence
  derived and/or modified sequence opt4 from capsid_protein_VP1__Norovirus__AGT17830
augaagauggccagcaacgacgccacccccagcgacggcagcagcgccaaccuggugcccgaggccaacaacgaggugauggcccuggagcccguggccggcgccgccaucgccgcccccguggccggccagcagaacgugaucgaccccuggaucagaaacaacuucgugcaggcccccggcggcgaguucaccgugagccccagaaacgcccccggcgagauccuguggagcgccagccugggccccgaccugaaccccuaccugagccaccugagcagaauguacaacggcuacgccggcagcuucgaggugcaggugauccuggccggcaacgccuucaccgccggcaagaucaucuucgccgccgugccccccaacuucagaaccgagggccugagccccagccagaucaccauguucccccacaucaucaccgacgugagacagcuggagcccgugcugaucccccugcccgacaucagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugaccagaaucggcaacagcagagaguacagaaugaaccuggccagccugaacuggaacaacuacgaccccaccgaggagauccccgccccccugggcacccccgacuucgccggcaagauccagggcgugcugacccagaccaccagacacgacggcagcaccagaggccacaaggccaccguguacaccggcagcgccggcuucacccccaagcugggcagcgugcaguucagcaccgacaccgacaacgaccuggaggccaaccagaacaccagauucacccccgugggcgugauccaggacggcaacgcccaccagggcgagccccagcagugggugcugcccaacuacgccggcagagacggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggagagcgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcgccggcagaagaagagcccuguga

SEQ ID NO: 22240 - RNA, 1623 nt, Artificial Sequence
  derived and/or modified sequence opt4 from capsid_protein_VP1__Norovirus__AGT17833
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgugaccaaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22241 - RNA, 1593 nt, Artificial Sequence; identical to SEQ ID NO: 22213
  derived and/or modified sequence opt4 from capsid_protein_VP1__Norovirus__AGT17836

SEQ ID NO: 22242 - RNA, 1620 nt, Artificial Sequence
  derived and/or modified sequence opt4 from capsid_protein_VP1__Norovirus__AGT17842
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccggccaggugaccauguucccccacaucaucguggacgugagacagcuggagcccgugcugaucccccugcccgacgugagaaacaacuucuaccacuacaaccagagcaacgaccccaccaucaagcugguggccaugcuguacaccccccugagagccaacaacgccggcgacgacguguucaccgugagcugcagagugcugaccagacccagccccgacuucgacuucaucuuccuggugccccccaccaucgagagcaagaccaagagcuucagcgugcccauccugaccaucgaggagaugaccaacagcagauuccccaucccccuggagaagcuguucaccggccccagcagcacccugguggugcagccccagaacggcagaugcaccaccgacggcgugcugcugggcaccacccagcugagccccgugaacaucugcaccuucagaggcgacgugacccagaucaccaacacccacagcuacgagaugaaccuggccgcccagaacuggaacagcuacgaccccaccgaggagauccccgccccccugggcacccccgacuucgugggcaagauccagggcgugcugacccagaccaccaaggagaacggcagcaccagagcccacaaggccaccguguacaccggcagcaccggcuucacccccaagcugggcagagugcaguucgugaccgacaccgacagagaccuggagaccaaccaggacaccaaguucacccccgugggcgugauccaggacggcgacgcccaccagaacgagccccagcagugggugcugcccagcuaccugggcaccaacaaccacaacgugcaccuggcccccgccguggcccccaccuuccccggcgagcagcugcuguucuucagaagcaccaugcccggcugcagcggcuaccccaacaugaaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggcagacacgaccuggugaucccccccaacggcuacuucagauucgacagcugggugagccccuucuacacccuggcccccaugggcaacggcaccggcagaagaagagcccuguga

SEQ ID NO: 22243 - RNA, 1623 nt, Artificial Sequence
  derived and/or modified sequence opt4 from capsid_protein_VP1__Norovirus__AGU68328
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucgccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcacccugagaggcgacgugacccacaucaccggcagcagaaacuacaccaugaaccuggccagccagaacuggaacaacuacgaccccaccgaggagauccccgccccccugggcacccccgacuucgugggcaagauccagggcaugcugacccagaccaccagaaccgacggcagcaccagaggcuacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagugguguga

SEQ ID NO: 22244 - RNA, 1620 nt, Artificial Sequence
  derived and/or modified sequence opt4 from capsid_protein_VP1__Norovirus__AGX85889
augaagauggccagcagcgacgccaaccccagcgacggcagcaccgccaaccuggugcccgaggccaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccugagcagaauguacaacggcuacgccggcggcuucgaggugcaggugauccuggccggcaacgccuucgccgccggcaagaucaucuucgccgccgugccccccaacuuccccaccgagggccugagccccagccaggugaccauguucccccaccugaucguggacgugagacagcuggagcccgugaugaucccccugcccgacaucagaaacaacuucuaccacuacaaccagagcaacgaccccaccaucaagcugaucgccaugcuguacaccccccugagagccaacaacgugggcgacgacguguucaccgugagcugcagagugcugaccagacccagccccgacuucgacuucaucuuccuggugccccccaccguggagagcaagaccaaccccuucagcgugcccauccugaccaucgaggagaugaccaacagcagauuccccaucccccuggagaagcuguucaccggccccagcagcgcccugguggugcagccccagaacggcagaugcaccaccgacggcgugcugcugggcaccacccagcugagccccgugaacaucugcaccuucagaggcgacgugacccacaccaccaagacccacaccuaccagaugaaccuggccgcccagaacuggaacagcuacgaccccaccgaggagauccccgccccccugggcacccccgacuucgugggcaagauccagggcgugcugacccagaccaccaagggcaacggcagcaccagagcccacaaggccaccguguacaccggcagcgccgaguucacccccaagcugggcagaauccagcuguucaccgacaccgacaacgaccuggaggccaaccagaacaccaaguucacccccgugggcgugauccaggacggcgacacccaccagaacgagccccagcagugggugcugcccagcuacagcggcagaaacaaccacaacgugcaccuggcccccgccguggcccccaccuuccccggcgagcagcugcuguucuucagaagcaccaugcccggcugcagcggcuaccccaacaugaaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccaccacgaccuguucaucccccccaacggcuacuucagauucgacagcugggugagccccuucuacacccuggcccccaugggcaacggcaccggcagaagaagagcccuguga

SEQ ID NO: 22245 - RNA, 1620 nt, Artificial Sequence
  derived and/or modified sequence opt4 from capsid_protein_VP1__Norovirus__AGX85892
augaagauggccagcagcgacgccaaccccagcgacggcagcaccgccaaccuggugcccgaggccaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgaggugcuguggagcgccccccugggccccgaccugaaccccuaccugagccaccuggccagaauguacaacggcuacgccggcggcuucgaggugcaggugauccuggccggcaacgccuucgccgccggcaagaucaucuucgccgccgugccccccaacuuccccaccgagggccugagccccagccaggugaccauguucccccaccugaucguggacgugagacagcuggagcccgugaugaucccccugcccgacaucagaaacaacuucuaccacuacaaccagagcaacgaccccaccaucaagcugaucgccaugcuguacaccccccugagagccaacaacgugggcgacgacguguucaccgugagcugcagagugcugaccagacccagccccgacuucgacuucaucuuccuggugccccccaccguggagagcaagaccaaccccuucagcgugcccauccugaccaucgaggagaugaccaacagcagauuccccaucccccuggagaagcuguucaccggccccagcagcgcccugguggugcagccccagaacggcagaugcaccaccgacggcgugcugcugggcaccacccagcugagccccgugaacaucugcaccuucagaggcgacgugacccacaccaccaagacccacaccuaccagaugaaccuggccgcccagaacuggaacagcuacgaccccaccgaggagauccccgccccccugggcacccccgacuucgugggcaagauccagggcgugcugacccagaccaccaagggcaacggcagcaccagagcccacaaggccaccguguacaccggcggcguggaguucacccccaagcugggcagaauccagcuguucaccgacaccgacaacgaccuggaggccaaccagaacaccaaguucacccccgugggcgugauccaggacggcgacacccaccagaacgagccccagcagugggugcugcccagcuacagcggcagaaacaaccacaacgugcaccuggcccccgccguggcccccaccuuccccggcgagcagcugcuguucuucagaagcaccaugcccggcugcagcggcuaccccaacaugaaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccaccacgaccuguucaucccccccaacggcuacuucagauucgacagcugggugagccccuucuacacccuggcccccaugggcaacggcaccggcagaagaagagcccuguga

SEQ ID NO: 22246 - RNA, 1620 nt, Artificial Sequence
  derived and/or modified sequence opt4 from capsid_protein_VP1__Norovirus__AGX85895
augaagauggccagcagcgacgccaaccccagcgacggcagcaccgccaaccuggugcccgaggccaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgaggugcuguggagcgccccccugggccccgaccugaaccccuaccugagccaccuggccagaauguacaacggcuacgccggcggcuucgaggugcaggugauccuggccggcaacgccuucgccgccggcaagaucaucuucgccgccgugccccccaacuuccccaccgagggccugagccccagccaggugaccauguucccccaccugaucaucgacgugagacagcuggagcccgugaugaucccccugcccgacgugagaaacaacuucuaccacuacaaccagagcaacgaccccaccaucaagcugaucgccaugcuguacaccccccugagagccaacaacgugggcgacgacguguucaccgugagcugcagagugcugaccagacccagccccgacuucgacuucaucuuccuggugccccccaccguggagagcaagaccaaccccuucagcgugcccauccugaccaucgaggagaugaccaacagcagauuccccaucccccuggagaagcuguucaccggccccagcagcgcccugguggugcagccccagaacggcagaugcaccaccgacggcgugcugcugggcaccacccagcugagccccgugaacaucugcaccuucagaggcgacgugacccacaucaccaagacccacagcuaccagaugaaccuggccgcccagaacuggaacagcuacgaccccaccgaggagauccccgccccccugggcacccccgacuucgugggcaagauccagggcgugcugacccagaccaccaagggcaacggcagcaccagagcccacaaggccaccguguacaccggcagcaccgaguucacccccaagcugggcagaauccagcuggugaccgacaccgacaacgaccuggagaccaaccagaacaccaaguucacccccgugggcgugauccaggacggcgacacccaccagaacgagccccagcagugggugcugcccagcuaccugggcagaaacaaccacaacgugcaccuggcccccgccguggcccccaccuuccccggcgagcagcugcuguucuucagaagcaccaugcccggcugcagcggcuaccccaacaugaaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccaccacgaccuguucaucccccccaacggcuacuucagauucgacagcugggugagccccuucuacacccuggcccccaugggcaacggcaccggcagaagaagagcccuguga

SEQ ID NO: 22247 - RNA, 1623 nt, Artificial Sequence
  derived and/or modified sequence opt4 from capsid_protein_VP1__Norovirus__AGX85904
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaagcaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggagcaacuacgaccccaccgaggagauccccgccccccugggcacccccgacuucgugggcaagauccagggcgugcugacccagaccaccaagggcgacggcagcaccagaggccacaaggccaccguguacaccggcagcgccgacuucacccccaagcugggcagcauccaguucgccaccgacaccgagaacgacuucgagacccaccagaacaccagauucacccccgugggcgugauccaggacggcggcaccacccacagaaacgagccccagcagugggugcugcccagcuacagcggcagaaacgugcacaacgugcaccuggcccccgccguggcccccaacuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22248 - RNA, 1617 nt, Artificial Sequence
  derived and/or modified sequence opt4 from capsid_protein_VP1__Norovirus__AGX85913
augaagauggccagcagcgacgccaaccccagcgacggcagcaccgccaaccuggugcccgaggccaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgaggugcuguggagcgccccccugggccccgaccugaaccccuaccugagccaccuggccagaauguacaacggcuacgccggcggcuucgaggugcaggugauccuggccggcaacgccuucgccgccggcaagaucaucuucgccgccgugccccccaacuucagcaccgagggccugagccccagccaggugaccauguucccccaccugaucguggacgugagacagcuggagcccgugaugaucccccugcccgacaucagaaacaacuucuaccacuacaaccagagcaacgaccccaccaucaagcugaucgccaugcuguacaccccccugagagccaacaacgugggcgacgacguguucaccgugagcugcagagugcugaccagacccagccccgacuucgacuucaucuuccuggugccccccaccguggagagcaagaccaaccccuucagcgugcccauccugaccaucgaggagaugaccaacagcagauuccccaucccccuggagaagcuguucaccggccccagcagcgcccugguggugcagccccagaacggcagaugcaccaccgacggcgugcugcugggcaccacccagcugagccccgugaacaucugcaccuucagaggcgacgugacccacaccaccaagacccacaccuaccagaugaaccuggccgcccagaacuggaacagcuacgaccccaccgaggagauccccgccccccugggcacccccgacuucgugggcaagauccagggcgugcugacccagaccaccaaggagaacggcagcaccagagcccacaaggccaccguguacaccggcaccguggaguucacccccaagcugggcagaauccagcuguucaccgacaccgacaacgaccuggaggccaaccagaacaccaaguucacccccgugggcgugauccaggacggcgaccaccagaacgagccccagcagugggugcugcccagcuacagcggcagaaacaaccacaacgugcaccuggcccccgccguggcccccaccuuccccggcgagcagcugcuguucuucagaagcaccaugcccggcugcagcggcuaccccaacaugaaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccaccacgaccuggugaucccccccaacggcuacuucagauucgacagcugggugagccccuucuacacccuggcccccaugggcaacggcaccggcagaagaagagcccuguga

SEQ ID NO: 22249 - RNA, 1623 nt, Artificial Sequence
  derived and/or modified sequence opt4 from capsid_protein_VP1__Norovirus__AGX85916
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcaccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgacaccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcagcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagccguguga

SEQ ID NO: 22250 - RNA, 1617 nt, Artificial Sequence; identical to SEQ ID NO: 22248
  derived and/or modified sequence opt4 from capsid_protein_VP1__Norovirus__AGX85931

SEQ ID NO: 22251 - RNA, 1617 nt, Artificial Sequence
  derived and/or modified sequence opt4 from capsid_protein_VP1__Norovirus__AGX85934
augaagauggccagcagcgacgccaaccccagcgacggcagcaccgccaaccuggugcccgaggccaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgaggugcuguggagcgccccccugggccccgaccugaaccccuaccugagccaccuggccagaauguacaacggcuacgccggcggcuucgaggugcaggugauccuggccggcaacgccuucgccgccggcaagaucaucuucgccgccgugccccccaacuucagcaccgagggccugagccccagccaggugaccauguucccccaccugaucguggacgugagacagcuggagcccgugaugaucccccugcccgacaucagaaacaacuucuaccacuacaaccagagcaacgaccccaccaucaagcugaucgccaugcuguacaccccccugagagccaacaacgugggcgacgacguguucaccgugagcugcagagugcugaccagacccagccccgacuucgacuucaucuuccuggugccccccaccguggagagcaagaccaaccccuucagcgugcccauccugaccaucgaggagaugaccaacagcagauuccccaucccccuggagaagcuguucaccggccccagcagcgcccugguggugcagccccagaacggcagaugcaccaccgacggcgugcugcugggcaccacccagcugagccccgugaacaucugcaccuucagaggcgacgugacccacaccaccaagacccacaccuaccagaugaaccuggccgcccagaacuggaacagcuacgaccccaccgaggagauccccgccccccugggcacccccgacuucgugggcaagauccagggcgugcugacccagaccaccaagggcaacggcagcaccagagcccacaaggccaccguguacaccggcaccguggaguucacccccaagcugggcagaauccagcuguucaccgacaccgacaacgaccuggaggccaaccagaacaccaaguucacccccgugggcgugauccaggacggcgaccaccagaacgagccccagcagugggugcugcccagcuacagcggcagaaacaaccacaacgugcaccuggcccccgccguggcccccaccuuccccggcgagcagcugcuguucuucagaagcaccaugcccggcugcagcggcuaccccaacaugaaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccaccacgaccuggugaucccccccaacggcuacuucagauucgacagcugggugagccccuucuacacccuggcccccaugggcaacggcaccggcagaagaagagcccuguga

SEQ ID NO: 22252 - RNA, 1644 nt, Artificial Sequence
  derived and/or modified sequence opt4 from capsid_protein_VP1__Norovirus__AHI59154
augaagauggccagcaacgacgccgcccccagcaacgacggcgccgccaaccuggugcccgaggccaacaacgaggugauggcccuggagcccguggugggcgccagcaucgccgcccccguggugggccagcagaacaucaucgaccccuggaucagagagaacuucgugcaggccccccagggcgaguucaccgugagccccagaaacagccccggcgagaugcugcugaaccuggagcugggccccgagcugaaccccuaccugagccaccugagcagaauguacaacggcuacgccggcggcaugcaggugcagguggugcuggccggcaacgccuucaccgccggcaagaucaucuucgccgccgugcccccccacuuccccguggagaacaucagcgccgcccagaucaccaugugcccccacgugaucguggacgugagacagcuggagcccgugcugcugccccugcccgacaucagaaacagauucuuccacuacaaccaggagaacacccccagaaugagacugguggccaugcuguacaccccccugagagccaacagcggcgaggacguguucaccgugagcugcagagugcugaccagacccgcccccgacuucgaguucaccuuccuggugccccccaccguggagagcaagaccaagcccuucacccugcccauccugacccugggcgagcugagcaacagcagauuccccgcccccaucgacaugcuguacaccgaccccaacgagggcaucguggugcagccccagaacggcagaugcacccuggacggcacccugcagggcaccacccagcuggugcccacccagaucugcgccuucagaggcacccugaucggccagaccagcagaagcagcgacagcaccgacagcgcccccagaagaagagaccacccccugcacgugcagcugaagaaccuggacggcacccaguacgaccccaccgacgaggugcccgccgugcugggcgccaucgacuucaagggcaccguguucggcguggccagccagagagacgugagcggccagcaggugggcgccaccagagcccacgaggugcacaucaacaccaccgaccccagauacacccccaagcugggcagcauccugaugcacagcgagagcgacgacuucgugaccggccagcccgugagauucacccccaucggcaugggcgacaacgacuggcaccagugggagcugcccgacuacagcggccaccugacccugaacaugaaccuggcccccgccguggcccccgccuuccccggcgagagaauccuguucuucagaagcauggugcccagcgccggcggcuacggcagcggccagaucgacugccugaugccccaggagugggugcagcacuucuaccaggaggccgcccccagccagagcgccguggcccugaucagauacgugaaccccgacaccggcagaaacaucuucgaggccaagcugcacagagagggcuucaucaccguggccaacagcggcaacaaccccaucguggugccccccaacggcuacuucagauucgaggccugggugaaccaguucuacacccugacccccaugggcaccggccagggcagaagaagaaaccaguga

SEQ ID NO: 22253 - RNA, 1623 nt, Artificial Sequence
  derived and/or modified sequence opt4 from capsid_protein_VP1__Norovirus__AHI59157
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22254 - RNA, 1629 nt, Artificial Sequence
  derived and/or modified sequence opt4 from capsid_protein_VP1__Norovirus__AHI59159
augaagauggccagcaacgacgccgcccccagcaccgacggcgccgccggccuggugcccgagagcaacagcgaggugauggcccuggagcccguggccggcgccgcccuggccgcccccgugaccggccagaccaacaucaucgaccccuggaucagagccaacuucgugcaggcccccaacggcgaguucaccgugagccccagaaacgcccccggcgaggugcugcugaaccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccguggagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauuccccgugagcaucgaccagauguacaccagccccaacgaggugaucagcgugcagugccagaacggcagaugcacccuggacggcgagcugcagggcaccacccagcugcaggugagcggcaucugcgccuucaagggcgaggugaccgcccaccugcacgacaacgaccaccuguacaacgugaccaucaccaaccugaacggcagccccuucgaccccagcgaggacgugcccgccccccugggcgugcccgacuuccagggcagaguguucggcgugaucagccagagagacaagcacaacagccccggccacaacgagcccgccaacagaggccacgacgccguggugcccaccuacaccgcccaguacacccccaagcugggccaggugcagaucggcaccuggcagaccgacgaccugaccgugaaccagcccgugaaguucacccccgugggccugaacgacaccgagcacuucaaccaguggguggugcccagauacgccggcgcccugaaccugaacaccaaccuggcccccagcguggcccccguguuccccggcgagagacugcuguucuucagaagcuacgugccccugaagggcggcuacggcaaccccgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagagugcaguga

SEQ ID NO: 22255 - RNA, 1623 nt, Artificial Sequence
  derived and/or modified sequence opt4 from capsid_protein_VP1__Norovirus__AHK24788
augagaaugagcgacggcgccgcccccaaggccaacggcagcgaggccagcggccaggaccuggugcccaccgccguggagcaggccgugcccauccagcccguggccggcgccagccuggccgcccccgccgccggccagaucaaccagaucgaccccuggaucuuccagaacuucgugcagugcccccugggcgaguucagcaucagccccagaaacacccccggcgagauccuguucgaccuggcccugggccccggccugaaccccuaccuggcccaccugagcgccauguacaccggcugggugggcaacauggaggugcagcuggugcuggccggcaacgccuucaccgccggcaagguggugguggcccuggugccccccuacuuccccaagggcagccugaccgccgcccagaucaccugcuucccccacgugaugugcgacgugagaacccuggagcccauccagcugccccugcuggacgugagaagagugcuguggcacgccacccaggaccaggaggagagcaugagacuggugugcaugcuguacaccccccugagaaccaacagccccggcgacgagagcuucguggugagcggcagacugcugagcaagcccgccgccgacuucaacuucguguaccugaccccccccaucgagagaaccaucuacagaaugguggaccugcccgugcugcagcccagacugugcacccacgccagauggcccgcccccguguacggccugcugguggaccccagccugcccagcaacccccaguggcagaacggcagagugcacguggacggcacccugcugggcaccacccccgugagcggcagcugggugagcugcuucgccgccgaggccgccuacgaguuccagagcggcaccggcgagguggccaccuucacccugaucgagcaggacggcagcgccuacgugcccggcgacagagccgccccccugggcuaccccgacuucagcggccagcuggagaucgaggugcagaccgagaccaccaaggccggcgacaagcugaaggugaccaccuucgagaugauccugggccccaccaccaacguggaccaggcccccuaccagggcagaguguacgccagccugaccgccgccgccagccuggaccugguggacggcagagugagagccgugcccagaagcaucuacggcuuccaggaccagauccccgaguacaacgacggccugcuggugccccuggccccccccgugggccccuuccugcccggcgagcugcugcugagauucagaaccuacaugagacagaucgacagcgccgacgccgccgccgaggccaucgacugcgcccugccccaggaguucaucagcugguucgccagcaacgccuucaccgugcagagcgaggcccugcugcugagauacagaaacacccugaccggccagcugcuguucgagugcaagcuguacagcgagggcuacaucgcccugagcuacagcggcagcggcccccugaccuuccccaccgacggcuucuucgagguggugagcugggugcccagacuguaccagcuggccagcgugggcagccuggccaccggcagaacccugaaguga

SEQ ID NO: 22256 - RNA, 1623 nt, Artificial Sequence
  derived and/or modified sequence opt4 from capsid_protein_VP1__Norovirus__AHX22018
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagugguguga

SEQ ID NO: 22257 - RNA, 1623 nt, Artificial Sequence
  derived and/or modified sequence opt4 from capsid_protein_VP1__Norovirus__AHX22021
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucaccaccgacaccgacaacgacuucgugaccaaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22258 - RNA, 1623 nt, Artificial Sequence
  derived and/or modified sequence opt4 from capsid_protein_VP1__Norovirus__AHX22025
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcagaccauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagaccaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22259 - RNA, 1623 nt, Artificial Sequence
  derived and/or modified sequence opt4 from capsid_protein_VP1__Norovirus__AHX22028
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagugguguga

SEQ ID NO: 22260 - RNA, 1623 nt, Artificial Sequence
  derived and/or modified sequence opt4 from capsid_protein_VP1__Norovirus__AHX22032
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcagaccauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagaccaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcggcaccacccaccagaacgagccccagcagugggugcugcccagcuacagcggcagagacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22261 - RNA, 1623 nt, Artificial Sequence
  derived and/or modified sequence opt4 from capsid_protein_VP1__Norovirus__AHX22038
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccugaacuggaacaacuacgaccccaccgaggagauccccgccccccugggcacccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagugguguga

SEQ ID NO: 22262 - RNA, 1623 nt, Artificial Sequence
  derived and/or modified sequence opt4 from capsid_protein_VP1__Norovirus__AHX22041
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagccacaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgccaccgacaccgaccacgacuucgaggccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagugguguga

SEQ ID NO: 22263 - RNA, 1623 nt, Artificial Sequence
  derived and/or modified sequence opt4 from capsid_protein_VP1__Norovirus__AHX22047
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcagcgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22264 - RNA, 1623 nt, Artificial Sequence
  derived and/or modified sequence opt4 from capsid_protein_VP1__Norovirus__AHX22050
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgugaccaaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22265 - RNA, 1623 nt, Artificial Sequence
  derived and/or modified sequence opt4 from capsid_protein_VP1__Norovirus__AHX22054
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugauccacaucagcggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgugaccaaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22266 - RNA, 1647 nt, Artificial Sequence
  derived and/or modified sequence opt4 from capsid_protein_VP1__Norovirus__AIA96988
augaagauggccagcaacgacgccgcccccagcaacgacggcgccgccggccuggugcccgagaucagcaacgaggccauggcccuggaccccguggccggcgccgccaucgccgccccccugaccggccagcagaacaucaucgaccccuggaucaugaacaacuucgugcaggcccccggcggcgaguucaccgugagccccagaaacagccccggcgagauccugcugaaccuggagcugggccccgagaucaaccccuaccuggcccaccuggccagaauguacaacggcuacgccggcggcuucgaggugcagguggugcuggccggcaacgccuucaccgccggcaaggugaucuucgccgccaucccccccaacuuccccaccgacaaccugagcgccgcccagaucaccaugugcccccacgugaucguggacgugagacagcuggagcccaucaaccugcccaugcccgacgugagaaacaacuucuuccacuacaaccagggcagcgacagcagacugagacugaucgccaugcuguacaccccccugagagccaacaacagcggcgacgacguguucaccgugagcugcagagugcugaccagacccagccccgacuucagcuucaacuuccuggugccccccaccguggagagcaagaccaagcccuucacccugcccauccugaccaucagcgagaugagcaacagcagauuccccgugcccaucgacagccugcacaccagccccaccgacaacaucguggugcagugccagaacggcagagugacccuggacggcgagcugaugggcaccacccagcugcugcccagccagaucugcgccuucagaggcgugcugaccagaagcaccagcagagccagcgaccacgccgacaccgccacccccagacuguucaacuacuacuggcacauccagcuggacaaccugaacggcacccccuacgaccccgccgaggacauccccgccccccugggcacccccgacuucagaggcaagguguucggcguggccagccagagaaaccccgacagcaccaccagagcccacgaggccaagguggacaccaccagcggcagauucacccccaagcugggcagccuggagaugagcaccgagagcgacgacuucgaccagaaccagcccaccagauucacccccgugggcaucggcguggacaacgaggccgacuuccagcaguggacccugcccgacuacagcggccaguucacccacaacaugaaccuggcccccgccguggcccccaacuuccccggcgagcagcugcuguucuucagaagccagcugcccagcagcggcggcagaagcaacggcauccuggacugccuggugccccaggagugggugcagcacuucuaccaggagagcgcccccgcccagacccagguggcccuggugagauacgugaaccccgacaccggcagagugcuguucgaggccaagcugcacaagcugggcuacaugaccaucgccaagagcggcgacagccccaucaccgugccccccaacggcuacuucagauucgagagcugggugaaccccuucuacacccuggcccccaugggcaccggcaacggcagaagaagaauccaguga

SEQ ID NO: 22267 - RNA, 1623 nt, Artificial Sequence
  derived and/or modified sequence opt4 from capsid_protein_VP1__Norovirus__AII02569
augaagauggccagcaacgacgccaaccccagcgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagaccaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcuguacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22268 - RNA, 1623 nt, Artificial Sequence; identical to SEQ ID NO: 22065
  derived and/or modified sequence opt4 from capsid_protein_VP1__Norovirus__AII02572

SEQ ID NO: 22269 - RNA, 1623 nt, Artificial Sequence; identical to SEQ ID NO: 22065
  derived and/or modified sequence opt4 from capsid_protein_VP1__Norovirus__AII02575

SEQ ID NO: 22270 - RNA, 1623 nt, Artificial Sequence; identical to SEQ ID NO: 22108
  derived and/or modified sequence opt4 from capsid_protein_VP1__Norovirus__AII02578

SEQ ID NO: 22271 - RNA, 1647 nt, Artificial Sequence
  derived and/or modified sequence opt4 from capsid_protein_VP1__Norovirus__AII02581
augaagauggccagcaacgacgccgcccccagcaacgacggcgccgccggccuggugcccgagaucaacagcgaggccauggcccuggagcccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcaggugcugcuggccggcaacgccuucaccgccggcaagaucaucuucgccgccaucccccccaacuuccccaucgacaaccugagcgccgcccagaucaccaugugcccccacgugaucguggacgugagacagcuggagcccgugaaccugcccaugcccgacgugagaaacaacuucuuccacuacaaccagggcagcgacagcagacugagacugaucgccaugcuguacaccccccugagagccaacaacagcggcgacgacguguucaccgugagcugcagagugcugaccagacccagccccgacuucagcuucaacuuccuggugccccccaccguggagagcaagaccaagcccuucagccugcccauccugaccaucagcgagaugagcaacagcagauuccccgugcccaucgacagccugcacaccagccccaccgagaacaucguggugcagugccagaacggcagagugacccuggacggcgagcugaugggcaccacccagcugcugcccagccagaucugcgccuucagaggcaugcugaccagaagcaccagcagagccagcgaccaggccgacaccgccacccccagacuguucaacuacuacuggcacauccagcuggacaaccugaacggcacccccuacgaccccgccgaggacauccccggcccccugggcacccccgacuucagaggcaagguguucggcguggccagccagagaaaccccgacgccaccaccagagcccacgaggccaagaucgacaccaccagcggcagauucacccccaagcugggcagccuggagaucagcaccgagagcggcgacuucgaccagaaccagcccaccagauucacccccgugggcaucggcguggaccacgaggccgacuuccagcaguggacccugcccgacuacgccggccaguucacccacaacaugaaccuggcccccgccguggcccccaacuuccccggcgagcagcugcuguucuucagaagccagcugcccagcagcggcggcagaagcaacggcauccuggacugccuggugccccaggagugggugcagcacuucuaccaggagagcgcccccagccagacccagguggcccuggugagauacgugaaccccgacaccggcagagugcuguucgaggccaagcugcacaagcugggcuucaugaccaucgccaagagcggcgacagccccaucaccgugccccccaacggcuacuucagauucgagagcugggugaaccccuucuacacccuggcccccaugggcaccggcaacggcagaagaagaauccaguga

SEQ ID NO: 22272 - RNA, 1623 nt, Artificial Sequence
  derived and/or modified sequence opt4 from capsid_protein_VP1__Norovirus__AII02584
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagaccaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22273 - RNA, 1623 nt, Artificial Sequence; identical to SEQ ID NO: 22065
  derived and/or modified sequence opt4 from capsid_protein_VP1__Norovirus__AII02590

SEQ ID NO: 22274 - RNA, 1623 nt, Artificial Sequence; identical to SEQ ID NO: 22112
  derived and/or modified sequence opt4 from capsid_protein_VP1__Norovirus__AII02593

SEQ ID NO: 22275 - RNA, 1623 nt, Artificial Sequence; identical to SEQ ID NO: 22065
  derived and/or modified sequence opt4 from capsid_protein_VP1__Norovirus__AII02596

SEQ ID NO: 22276 - RNA, 1623 nt, Artificial Sequence
  derived and/or modified sequence opt4 from capsid_protein_VP1__Norovirus__AII02599
augaagauggccagcaacgacgccaaccccagcgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagaccaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacaucacccacaucgccggcagcagagacuacaccaugaaccuggccagccugaacuggaacaacuacgaccccaccgaggagauccccgccccccugggcacccccgacuucgugggcaagauccagggcgugcugacccagaccaccaagagagacggcagcaccagaggccacaaggccaccguguacaccggcagcgcccccuucacccccaagcugggcagcgugagauucagcaccgacaccgagaacgacuucgagacccaccagaacaccaaguucacccccgugggcgugauccaggacggcagcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22277 - RNA, 1623 nt, Artificial Sequence; identical to SEQ ID NO: 22112
  derived and/or modified sequence opt4 from capsid_protein_VP1__Norovirus__AII02602

SEQ ID NO: 22278 - RNA, 1608 nt, Artificial Sequence
  derived and/or modified sequence opt4 from capsid_protein_VP1__Norovirus__AII02605
augaagauggccagcaacgacgccgcccccagcaacgacggcgccgccggccuggugcccgaggugaacaacgagaccauggcccuggagcccguggccggcgccagcaucgccgccccccugaccggccagaacaacgugaucgaccccuggaucagacugaacuucgugcaggcccccaacggcgaguucaccgugagccccagaaacagccccggcgaggugcugcugaaccuggagcugggccccgagcugaaccccuaccuggcccaccugagcagaauguacaacggcuacgccggcggcguggaggugcaggugcugcuggccggcaacgccuucaccgccggcaagcugguguucgccgccgugcccccccacuucccccuggagaacaucagccccggccagaucaccauguucccccacgugaucaucgacgugagaacccuggagcccgugcugcugccccugcccgacgugagaaacaacuucuuccacuacaaccagcagaacgagcccagaaugagacugguggccaugcuguacaccccccugagaagcaacggcagcggcgacgacguguucaccgugagcugcagagugcugaccagacccagccccgacuucgacuucaacuaccuggugccccccaccguggagagcaagaccaagcccuucacccugcccauccugaccaucggcgagcugaccaacagcagauuccccgugcccaucgacgagcuguacaccagccccaacgagagccugguggugcagccccagaacggcagaugcgcccuggacggcgagcugcagggcaccacccagcugcugcccaccgccaucugcagcuucagaggcagaaucaaccagaaggugagcggcgagaaccacguguggaacaugcaggugaccaacaucaacggcacccccuucgaccccaccgaggacgugcccgccccccugggcacccccgacuucagcggcaagcuguucggcgugcugagccagagagaccacgacaacgccugcagaagccacgacgccgugaucgccaccaacagcgccaaguucacccccaagcugggcgccauccagaucggcaccugggagcaggacgacgugcacaucaaccagcccaccaaguucacccccgugggccuguucgagagcgagggcuucaaccaguggacccugcccaacuacagcggcgcccugacccugaacaugggccuggccccccccguggcccccaccuuccccggcgagcagauccuguucuucagaagccacaucccccugaagggcggcguggccgaccccgugaucgacugccugcugccccaggaguggauccagcaccuguaccaggagagcgcccccagccagaccgacguggcccugaucagauucaccaaccccgacaccggcagagugcuguucgaggccaagcugcacagaagcggcuacaucaccguggccaacaccggcagcagacccaucguggugcccgccaacggcuacuucagauucgacagcugggugaaccaguucuacagccuggcccccaugggcaccggcaacggcagaagaagagugcaguga

SEQ ID NO: 22279 - RNA, 1647 nt, Artificial Sequence
  derived and/or modified sequence opt4 from capsid_protein_VP1__Norovirus__AII02608
augaagauggccagcaacgacgccgcccccagcaacgacggcgccgccggccuggugcccgagaucaacagcgaggccauggcccuggagcccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgccuucaccgccggcaagaucaucuucgccgccaucccccccaacuuccccaucgacaaccugagcgccgcccagaucaccaugugcccccacgugaucguggacgugagacagcuggagcccgugaaccugcccaugcccgacgugagaaacaacuucuuccacuacaaccagggcagcgacagcagacugagacugaucgccaugcuguacaccccccugagagccaacaacagcggcgacgacguguucaccgugagcugcagagugcugaccagacccagccccgacuucagcuucaacuuccuggugccccccaccguggagagcaagaccaagcccuucagccugcccauccugaccaucagcgagaugagcaacagcagauuccccgugcccaucgacagccugcacaccagccccaccgagaacaucguggugcagugccagaacggcagagugacccuggacggcgagcugaugggcaccacccagcugcugcccagccagaucugcgccuucagaggcaugcugaccagaagcaccagcagagccagcgaccaggccgacaccgccacccccagacuguucaacuacuacuggcacauccagcuggacaaccugaacggcacccccuacgaccccgccgaggacauccccggcccccugggcacccccgacuucagaggcaagguguucggcguggccagccagagaaaccccgacgccaccaccagagcccacgaggccaagaucgacaccaccagcggcagauucacccccaagcugggcagccuggagaucagcaccgagagcggcgacuucgaccagaaccagcccaccagauucacccccgugggcaucggcguggaccacgaggccgaccugcagcaguggacccugcccgacuacgccggccaguucacccacaacaugaaccuggcccccgccguggcccccaacuuccccggcgagcagcugcuguucuucagaagccagcugcccagcagcggcggcagaagcaacggcauccuggacugccuggugccccaggagugggugcagcacuucuaccaggagagcgcccccagccagacccagguggcccuggugagauacgugaaccccgacaccggcagagugcuguucgaggccaagcugcacaagcugggcuucaugaccaucgccaagagcggcgacagccccaucaccgugccccccaacggcuacuucagauucgagagcugggugaaccccuucuacacccuggcccccaugggcaccggcaacggcagaagaagaauccaguga

SEQ ID NO: 22280 - RNA, 1623 nt, Artificial Sequence; identical to SEQ ID NO: 22119
  derived and/or modified sequence opt4 from capsid_protein_VP1__Norovirus__AII02614

SEQ ID NO: 22281 - RNA, 1653 nt, Artificial Sequence
  derived and/or modified sequence opt4 from capsid_protein_VP1__Norovirus__AII02623
augaagauggccagcaacgacgccacccccagcaacgacggcgccgccaaccuggugcccgaggccaacaacgaggugauggcccuggagcccguggugggcgccagcaucgccgcccccguggugggccagcagaacaucaucgaccccuggaucagagagaacuucgugcaggccccccagggcgaguucaccgugagccccagaaacagccccggcgagaugcugcugaaccuggagcugggccccgagcugaaccccuaccugagccaccugagcagaauguacaacggcuacgccggcggcaugcaggugcagguggugcuggccggcaacgccuucaccgccggcaagaucaucuucgccgccgugcccccccacuuccccguggacaacaucagcgccgcccagaucaccaugugcccccacgugaucguggacgugagacagcuggagcccgugcugcugccccugcccgacaucagaaacagauucuuccacuacaaccaggagaacacccccagaaugagacugguggccaugcuguacaccccccugagagccaacagcggcgaggacguguucaccgugagcugcagagugcugaccagacccgcccccgacuucgaguucaccuuccuggugccccccaccguggagagcaagaccaagcccuucacccugcccauccugacccugggcgagcugagcaacagcagauuccccgccgccaucgacaugcuguacaccgaccccaacgagagcaucguggugcagccccagaacggcagaugcacccuggacggcacccugcagggcaccacccagcuggugcccacccagaucugcgccuucagaggcacccugaucagccagaccgccagagccgccgacagcaccgacuucccccagagagccagaaaccacccccugcacgugcaggugaagaaccuggacggcacccaguacgaccccaccgacgacauccccgccgugcugggcgccaucgacuucaagggcaccguguucggcguggccagccagagagacgugagcggcacccaggagcagggccacuacgccaccagagcccacgaggcccacaucgacaccaccgaccccaaguacgcccccaagcugggcaccauccugaucaagagcgagagcaccgacuucaacaccaaccagcccaucagauucacccccgugggcaugggcgacaacaacuggagacagugggagcugcccgacuacagcggcagccugacccugaacaugaaccuggcccccgccgugagccccagcuuccccggcgagagaauccuguucuucagaagcaucgugcccagcgccggcggcuacggcagcggcuacaucgacugccugaucccccaggagugggugcagcacuucuaccaggaggccgcccccagccagagcgccguggcccuggugagauacgugaaccccgacaccggcagaaacaucuucgaggccaagcugcacagagagggcuuccugaccguggccaacagcggcaacaaccccaucguggugccccccaacggcuacuucagauucgaggccugggugaaccaguucuacacccuggcccccaugggcagcggccagggcagaagaagagcccaguga

SEQ ID NO: 22282 - RNA, 1623 nt, Artificial Sequence; identical to SEQ ID NO: 22065
  derived and/or modified sequence opt4 from capsid_protein_VP1__Norovirus__AII02626

SEQ ID NO: 22283 - RNA, 1647 nt, Artificial Sequence
  derived and/or modified sequence opt4 from capsid_protein_VP1__Norovirus__AII02629
augaagauggccagcaacgacgccgcccccagcaacgacggcgccgccggccuggugcccgagaucaacagcgaggccauggcccuggagcccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgccuucaccgccggcaagaucaucuucgccgccaucccccccaacuuccccaucgacaaccugagcgccgcccagaucaccaugugcccccacgugaucguggacgugagacagcuggagcccgugaaccugcccaugcccgacgugagaaacaacuucuuccacuacaaccagggcagcgacagcagacugagacugaucgccaugcuguacaccccccugagagccaacaacagcggcgacgacguguucaccgugagcugcagagugcugaccagacccagccccgacuucagcuucaacuuccuggugccccccaccguggagagcaagaccaagcccuucagccugcccauccugaccaucagcgagaugagcaacagcagauuccccgugcccaucgacagccugcacaccagccccaccgagaacaucguggugcagugccagaacggcagagugacccuggacggcgagcugaugggcaccacccagcugcugcccagccagaucugcgccuucagaggcaugcugaccagaagcaccagcagagccagcgaccaggccgacaccgccacccccagacuguucaacuacuacuggcacauccagcuggacaaccugaacggcacccccuacgaccccgccgaggacauccccggcccccugggcacccccgacuucagaggcaagguguucggcguggccagccagagaaaccccgacgccaccaccagagcccacgaggccaagaucgacaccaccagcggcagauucacccccaagcugggcagccuggagaucagcaccgagagcggcgacuucgaccagaaccagcccaccagauucacccccgugggcaucggcguggaccacgaggccgacuuccagcaguggacccugcccgacuacgccggccaguucacccacaacaugaaccuggcccccgccguggcccccaacuuccccggcgagcagcugcuguucuucagaagccagcugcccagcagcggcggcagaagcaacggcauccuggacugccuggugccccaggagugggugcagcacuucuaccaggagagcgcccccagccagacccagguggcccuggugagauacgugaaccccgacaccggcagagugcuguucgaggccaagcugcacaagcugggcuucaugaccaucgccaagagcggcgacagccccaucaccgugccccccaacggcuacuucagauucgagagcugggugaaccccuucuacacccuggcccccaugggcaccggcaacggcagaagaagaauccaguga

SEQ ID NO: 22284 - RNA, 1623 nt, Artificial Sequence; identical to SEQ ID NO: 22115
  derived and/or modified sequence opt4 from capsid_protein_VP1__Norovirus__AII02632

SEQ ID NO: 22285 - RNA, 1623 nt, Artificial Sequence; identical to SEQ ID NO: 22065
  derived and/or modified sequence opt4 from capsid_protein_VP1__Norovirus__AII02635

SEQ ID NO: 22286 - RNA, 1608 nt, Artificial Sequence; identical to SEQ ID NO: 22278
  derived and/or modified sequence opt4 from capsid_protein_VP1__Norovirus__AII02638

SEQ ID NO: 22287 - RNA, 1623 nt, Artificial Sequence; identical to SEQ ID NO: 22065
  derived and/or modified sequence opt4 from capsid_protein_VP1__Norovirus__AII02641

SEQ ID NO: 22288 - RNA, 1647 nt, Artificial Sequence; identical to SEQ ID NO: 22283
  derived and/or modified sequence opt4 from capsid_protein_VP1__Norovirus__AII02644

SEQ ID NO: 22289 - RNA, 1623 nt, Artificial Sequence; identical to SEQ ID NO: 22100
  derived and/or modified sequence opt4 from capsid_protein_VP1__Norovirus__AII02647

SEQ ID NO: 22290 - RNA, 1623 nt, Artificial Sequence; identical to SEQ ID NO: 22112
  derived and/or modified sequence opt4 from capsid_protein_VP1__Norovirus__AII02650

SEQ ID NO: 22291 - RNA, 1623 nt, Artificial Sequence
  derived and/or modified sequence opt4 from capsid_protein_VP1__Norovirus__AII02653
augaagauggccagcaacgacgccaaccccagcgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagaccaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacgccgcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22292 - RNA, 1647 nt, Artificial Sequence; identical to SEQ ID NO: 22283
  derived and/or modified sequence opt4 from capsid_protein_VP1__Norovirus__AII02656

SEQ ID NO: 22293 - RNA, 1623 nt, Artificial Sequence; identical to SEQ ID NO: 22065
  derived and/or modified sequence opt4 from capsid_protein_VP1__Norovirus__AII02659

SEQ ID NO: 22294 - RNA, 1647 nt, Artificial Sequence; identical to SEQ ID NO: 22283
  derived and/or modified sequence opt4 from capsid_protein_VP1__Norovirus__AII02662

SEQ ID NO: 22295 - RNA, 1623 nt, Artificial Sequence; identical to SEQ ID NO: 22065
  derived and/or modified sequence opt4 from capsid_protein_VP1__Norovirus__AII02665

SEQ ID NO: 22296 - RNA, 1623 nt, Artificial Sequence; identical to SEQ ID NO: 22065
  derived and/or modified sequence opt4 from capsid_protein_VP1__Norovirus__AII02668

SEQ ID NO: 22297 - RNA, 1623 nt, Artificial Sequence; identical to SEQ ID NO: 22065
  derived and/or modified sequence opt4 from capsid_protein_VP1__Norovirus__AII02671

SEQ ID NO: 22298 - RNA, 1623 nt, Artificial Sequence
  derived and/or modified sequence opt4 from capsid_protein_VP1__Norovirus__AII02674
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucaucgugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgaggcccaccagaacaccaaguucacccccgugggcgugauccaggacggcggcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22299 - RNA, 1623 nt, Artificial Sequence; identical to SEQ ID NO: 22108
  derived and/or modified sequence opt4 from capsid_protein_VP1__Norovirus__AII02677

SEQ ID NO: 22300 - RNA, 1623 nt, Artificial Sequence
  derived and/or modified sequence opt4 from capsid_protein_VP1__Norovirus__AII02680
augaagauggccagcaacgacgccaaccccagcgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagaucaacgaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagagacauccacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22301 - RNA, 1623 nt, Artificial Sequence; identical to SEQ ID NO: 22065
  derived and/or modified sequence opt4 from capsid_protein_VP1__Norovirus__AII02683

SEQ ID NO: 22302 - RNA, 1623 nt, Artificial Sequence; identical to SEQ ID NO: 22065
  derived and/or modified sequence opt4 from capsid_protein_VP1__Norovirus__AII02689

SEQ ID NO: 22303 - RNA, 1623 nt, Artificial Sequence; identical to SEQ ID NO: 22152
  derived and/or modified sequence opt4 from capsid_protein_VP1__Norovirus__AII02692

SEQ ID NO: 22304 - RNA, 1623 nt, Artificial Sequence; identical to SEQ ID NO: 22115
  derived and/or modified sequence opt4 from capsid_protein_VP1__Norovirus__AII02695

SEQ ID NO: 22305 - RNA, 1623 nt, Artificial Sequence; identical to SEQ ID NO: 22065
  derived and/or modified sequence opt4 from capsid_protein_VP1__Norovirus__AII02698

SEQ ID NO: 22306 - RNA, 1623 nt, Artificial Sequence; identical to SEQ ID NO: 22065
  derived and/or modified sequence opt4 from capsid_protein_VP1__Norovirus__AII02701

SEQ ID NO: 22307 - RNA, 1623 nt, Artificial Sequence; identical to SEQ ID NO: 22065
  derived and/or modified sequence opt4 from capsid_protein_VP1__Norovirus__AII02707

SEQ ID NO: 22308 - RNA, 1623 nt, Artificial Sequence; identical to SEQ ID NO: 22119
  derived and/or modified sequence opt4 from capsid_protein_VP1__Norovirus__AII02710

SEQ ID NO: 22309 - RNA, 1647 nt, Artificial Sequence
  derived and/or modified sequence opt4 from capsid_protein_VP1__Norovirus__AII02713
augaagauggccagcaacgacgccgcccccagcaacgacggcgccgccggccuggugcccgagaucaacagcgaggccauggcccuggagcccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgccuucaccgccggcaagaucaucuucgccgccaucccccccaacuuccccaucgacaaccugagcgccgcccagaucaccaugugcccccacgugaucguggacgugagacagcuggagcccgugaaccugcccaugcccgacgugagaaacaacuucuuccacuacaaccagggcagcgacagcagacugagacugaucgccaugcuguacaccccccugagagccaacaacagcggcgacgacguguucaccgugagcugcagagugcugaccagacccagccccgacuucagcuucaacuuccuggugccccccaccguggagagcaagaccaagcccuucagccugcccauccugaccaucagcgagaugagcaacagcagauuccccgugcccaucgacagccugcacaccagccccaccgagaacaucguggugcagugccagaacggcagagugacccuggacggcgagcugaugggcaccacccagcugcugcccagccagaucugcgccuucagaggcaugcugaccagaagcaccagcagagccagcgaccaggccgacaccgccacccccagacuguucaacuacuacuggcacauccagcuggacaaccugaacggcacccccuacgaccccgccgaggacauccccggcccccugggcacccccgacuucagaggcaagguguucggcguggccagccagagaaaccccgacgccaccaccagagcccacgaggccaagaucgacaccaccagcggcagauucacccccaagcugggcagccuggagaucagcaccgagagcggcgacuucgaccagaaccagcccaccaucuucacccccgugggcaucggcguggaccacgaggccgacuuccagcaguggacccugcccgacuacgccggccaguucacccacaacaugaaccuggcccccgccguggcccccaacuuccccggcgagcagcugcuguucuucagaagccagcugcccagcagcggcggcagaagcaacggcauccuggacugccuggugccccaggagugggugcagcacuucuaccaggagagcgcccccagccagacccagguggcccuggugagauacgugaaccccgacaccggcagagugcuguucgaggccaagcugcacaagcugggcuucaugaccaucgccaagagcggcgacagccccaucaccgugccccccaacggcuacuucagauucgagagcugggugaaccccuucuacacccuggcccccaugggcaccggcaacggcagaagaagaauccaguga

SEQ ID NO: 22310 - RNA, 1647 nt, Artificial Sequence; identical to SEQ ID NO: 22283
  derived and/or modified sequence opt4 from capsid_protein_VP1__Norovirus__AII02716

SEQ ID NO: 22311 - RNA, 1650 nt, Artificial Sequence
  derived and/or modified sequence opt4 from capsid_protein_VP1__Norovirus__AII02719
augaagauggccagcaacgacgccgcccccagcaacgacggcgccgccaaccuggugcccgaggccaacaacgaggugauggcccuggagcccguggugggcgccagcaucgccgcccccguggugggccagcagaacaucaucgaccccuggaucagagagaacuucgugcaggccccccagggcgaguucaccgugagccccagaaacagccccggcgagaugcugcugaaccuggagcugggccccgagcugaaccccuaccugagccaccugagcagaauguacaacggcuacgccggcggcaugcaggugcagguggugcuggccggcaacgccuucaccgccggcaagaucaucuucgccgccgugcccccccacuuccccguggagaacaucaacgccgcccagaucaccaugugcccccacgugaucguggacgugagacagcuggagcccgugcugcugccccugcccgacaucagaaacagauucuuccacuacaaccaggaggacacccccagaaugagacugguggccaugcuguacaccccccugagagccaacagcggcgaggacguguucaccgugagcugcagagugcugaccagacccgcccccgacuucgaguucaccuuccuggugccccccaccguggagagcaagaccaagcccuucacccugcccauccugacccugggcgagcugagcaacagcagauuccccgcccccaucgacaugcuguacaccgaccccaacgagggcaucguggugcagccccagaacggcagaugcacccuggacggcacccugcagggcaccacccagcuggugcccacccagaucugcgccuucagaggcauccugaucggccagaccagcagaagccccgacagcgacagcaccgacagcgcccccagaagaagagaccacccccugcacaugcagcuggagaaccuggacggcacccaguacgaccccaccgacgaggugcccgccgcccugggcgccguggacuucaagggcaccaucuucggcguggccagccagagagacaccagcggcacccaggugggcgccaccagagcccacgaggugaucaucaacaccaccgaccccagauacacccccaagcugggcagcgugcugauguacagcgagagccaggacuucgagaccggccagcccaucagauucacccccaucggcaugggcgagaacgacuggcaccagugggagcugcccaacuacagcggcagacugacccugaacaugaaccuggcccccgccguggcccccgccuuccccggcgagagaauccuguucuucagaagcaucgugcccagcgccggcggcuacggcagcggccagaucgacugccugcugccccaggagugggugcagcacuucuaccaggaggccgcccccagccagagcgccguggcccugaucagauacgugaaccccgacaccggcagaaacaucuucgaggccaagcugcacagagagggcuucaucaccguggccaacagcggcaacaaccccaucguggugccccccaacggcuacuucagauucgaggccugggugaaccaguucuacacccugacccccaugggcaccggccagggcagaagaagaaaccaguga

SEQ ID NO: 22312 - RNA, 1650 nt, Artificial Sequence
  derived and/or modified sequence opt4 from capsid_protein_VP1__Norovirus__AII02722
augaagauggccagcaacgacgccgcccccagcaacgacggcgccgccaaccuggugcccgaggccaacaacgaggugauggcccuggagcccguggccggcgccagcaucgccgcccccguggugggccagcagaacaucaucgaccccuggaucagagagaacuucgugcaggccccccagggcgaguucaccgugagccccagaaacagccccggcgagaugcugcugaaccuggagcugggccccgagcugaaccccuaccugagccaccugagcagaauguacaacggcuacgccggcggcaugcaggugcagguggugcuggccggcaacgccuucaccgccggcaagaucaucuucgccgccgugcccccccacuuccccguggagaacaucaacgccgcccagaucaccaugugcccccacgugaucguggacgugagacagcuggagcccgugcugcugccccugcccgacaucagaaacagauucuuccacuacaaccaggaggacacccccagaaugagacugguggccaugcuguacaccccccugagagccaacagcggcgaggacguguucaccgugagcugcagagugcugaccagacccgcccccgacuucgaguucaccuuccuggugccccccaccguggagagcaagaccaagcccuucacccugcccauccugacccugggcgagcugagcaacagcagauuccccgcccccaucgacaugcuguacaccgaccccaacgagggcaucguggugcagccccagaacggcagaugcacccuggacggcacccugcagggcaccacccagcuggugcccacccagaucugcgccuucagaggcagacugaucggccagaccagcagaagccccgaccuggacagcaccgacagcgcccccagaagaagagaccacccccugcacaugcagcuggagaaccuggacggcacccaguacgaccccaccgacgaggugcccgccgcccugggcgccguggacuucaagggcaccaucuucggcguggccagccagagagacaccagcggcagccaggugggcgccaccagagcccacgaggugaccaucaacaccaccgaccccagauacacccccaagcugggcagcgugcugauguacagcgagagccaggacuucgagaccggccagcccaucagauucacccccaucggcaugggcgaggacgacuggcaccagugggagcugcccaacuacagcggcagacugacccugaacaugaaccuggcccccgccguggcccccgccuuccccggcgagagaauccuguucuucagaagcaucgugcccagcgccggcggcuacggcagcggccagaucgacugccugcugccccaggagugggugcagcacuucuaccaggaggccgcccccagccagagcgccguggcccugaucagauacgugaaccccgacaccggcagaaacaucuucgaggccaagcugcacagagagggcuucaucaccguggccaacagcggcaacaaccccaucguggugccccccaacggcuacuucagauucgaggccugggugaaccaguucuacacccugacccccaugggcaccggccagggcagaagaagaaaccaguga

SEQ ID NO: 22313 - RNA, 1623 nt, Artificial Sequence
  derived and/or modified sequence opt4 from capsid_protein_VP1__Norovirus__AII02725
augaagauggccagcaacgacgccaaccccagcgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagaccaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccgugccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22314 - RNA, 1623 nt, Artificial Sequence
  derived and/or modified sequence opt4 from capsid_protein_VP1__Norovirus__AII02728
augaagauggccagcaacgacgccaaccccagcgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagaccaacgaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagagacuacaccaugaaccuggccagccugaacuggaacaacuacgaccccaccgaggagauccccgccccccugggcacccccgacuucgugggcaagauccagggcgugcugacccagaccaccagaggcgacggcagcaccagaggccacaaggccaccguguacaccggcagcgcccccuucgcccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22315 - RNA, 1653 nt, Artificial Sequence
  derived and/or modified sequence opt4 from capsid_protein_VP1__Norovirus__AII02731
augaagauggccagcaacgacgccgcccccagcaacgacggcgccgccaaccuggugcccgaggccaacaacgaggugauggcccuggagcccguggugggcgccagcaucgccgcccccguggugggccagcagaacaucaucgaccccuggaucagagagaacuucgugcaggccccccagggcgaguucaccgugagccccagaaacagccccggcgagaugcugcugaaccuggagcugggccccgagcugaaccccuaccugagccaccugagcagaauguacaacggcuacgccggcggcaugcaggugcagguggugcuggccggcaacgccuucaccgccggcaagaucaucuucgccgccgugcccccccacuuccccguggacaacaucagcgccgcccagaucaccaugugcccccacgugaucguggacgugagacagcuggagcccgugcugcugccccugcccgacaucagaaacagauucuuccacuacaaccaggagaacacccccagaaugagacugguggccaugcuguacaccccccugagagccaacagcggcgaggacguguucaccgugagcugcagagugcugaccagacccgcccccgacuucgaguucaccuuccuggugccccccaccguggagagcaagaccaagcccuucacccugcccauccugacccugggcgagcugagcaacagcagauuccccgccgccaucgacaugcuguacaccgaccccaacgagagcaucguggugcagccccagaacggcagaugcacccuggacggcacccugcagggcaccacccagcuggugcccacccagaucugcgccuucagaggcacccugaucagccagaccgccagagccgccgacagcaccgacagcccccagagagccagaaaccacccccugcacgugcaggugaagaaccuggacggcacccaguacgaccccaccgacgacauccccgccgugcugggcgccaucgacuucaagggcaccguguucggcguggccagccagagagacgugagcggcacccaggagcagggccacuacgccaccagagcccacgaggcccacaucgacaccaccgaccccaaguacgcccccaagcugggcaccauccugaucaagagcgagagcaccgacuucaacaccaaccagcccaucagauucacccccgugggcaugggcgacaacaacuggagacagugggagcugcccgacuacagcggcagccugacccugaacaugaaccuggcccccgccgugagccccagcuuccccggcgagagaauccuguucuucagaagcaucgugcccagcgccggcggcuacggcagcggcuacaucgacugccugaucccccaggagugggugcagcacuucuaccaggaggccgcccccagccagagcgccguggcccuggugagauacgugaaccccgacaccggcagaaacaucuucgaggccaagcugcacagagagggcuuccugaccguggccaacagcggcaacaaccccaucguggugccccccaacggcuacuucagauucgaggccugggugaaccaguucuacacccuggcccccaugggcagcggccagggcagaagaagagcccaguga

SEQ ID NO: 22316 - RNA, 1623 nt, Artificial Sequence; identical to SEQ ID NO: 22065
  derived and/or modified sequence opt4 from capsid_protein_VP1__Norovirus__AII02734

SEQ ID NO: 22317 - RNA, 1623 nt, Artificial Sequence; identical to SEQ ID NO: 22065
  derived and/or modified sequence opt4 from capsid_protein_VP1__Norovirus__AII02737

SEQ ID NO: 22318 - RNA, 1623 nt, Artificial Sequence
  derived and/or modified sequence opt4 from capsid_protein_VP1__Norovirus__AII02740
augaagauggcccccaacgacgccaaccccagcgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggggcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagaccaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaacggccagcacgaccuggugaucccccccaacggcuacuucagauucgacagcugggugaaccaguucuacacccuggcccccaugggcaacggcaccggcagaagaagagcccuguga

SEQ ID NO: 22319 - RNA, 1623 nt, Artificial Sequence; identical to SEQ ID NO: 22098
  derived and/or modified sequence opt4 from capsid_protein_VP1__Norovirus__AII02743

SEQ ID NO: 22320 - RNA, 1623 nt, Artificial Sequence; identical to SEQ ID NO: 22298
  derived and/or modified sequence opt4 from capsid_protein_VP1__Norovirus__AII02746

SEQ ID NO: 22321 - RNA, 1623 nt, Artificial Sequence; identical to SEQ ID NO: 22065
  derived and/or modified sequence opt4 from capsid_protein_VP1__Norovirus__AII02749

SEQ ID NO: 22322 - RNA, 1623 nt, Artificial Sequence; identical to SEQ ID NO: 22147
  derived and/or modified sequence opt4 from capsid_protein_VP1__Norovirus__AII02752

SEQ ID NO: 22323 - RNA, 1623 nt, Artificial Sequence; identical to SEQ ID NO: 22112
  derived and/or modified sequence opt4 from capsid_protein_VP1__Norovirus__AII02758

SEQ ID NO: 22324 - RNA, 1623 nt, Artificial Sequence
  derived and/or modified sequence opt4 from capsid_protein_VP1__Norovirus__AII02761
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccaccugaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22325 - RNA, 1623 nt, Artificial Sequence; identical to SEQ ID NO: 22065
  derived and/or modified sequence opt4 from capsid_protein_VP1__Norovirus__AII02764

SEQ ID NO: 22326 - RNA, 1623 nt, Artificial Sequence; identical to SEQ ID NO: 22065
  derived and/or modified sequence opt4 from capsid_protein_VP1__Norovirus__AII02767

SEQ ID NO: 22327 - RNA, 1647 nt, Artificial Sequence; identical to SEQ ID NO: 22283
  derived and/or modified sequence opt4 from capsid_protein_VP1__Norovirus__AII02770

SEQ ID NO: 22328 - RNA, 1623 nt, Artificial Sequence; identical to SEQ ID NO: 22065
  derived and/or modified sequence opt4 from capsid_protein_VP1__Norovirus__AII02773

SEQ ID NO: 22329 - RNA, 1650 nt, Artificial Sequence
  derived and/or modified sequence opt4 from capsid_protein_VP1__Norovirus__AII02776
augaagauggccagcaacgacgccgcccccagcaacgacggcgccgccaaccuggugcccgaggccaacaacgaggugauggcccuggagcccguggugggcgccagcaucgccgcccccguggugggccagcagaacaucaucgaccccuggaucagagagaacuucgugcaggccccccagggcgaguucaccgugagccccagaaacagccccggcgagaugcugcugaaccuggagcugggccccgagcugaaccccuaccugagccaccugagcagaauguacaacggcuacgccggcggcaugcaggugcagguggugcuggccggcaacgccuucaccgccggcaagaucaucuucgccgccgugcccccccacuuccccguggagaacaucaacgccgcccagaucaccaugugcccccacgugaucguggacgugagacagcuggagcccgugcugcugccccugcccgacaucagaaacagauucuuccacuacaaccaggaggacacccccagaaugagacugguggccaugcuguacaccccccugagagccaacagcggcgaggacguguucaccgugagcugcagagugcugaccagacccgcccccgacuucgaguucaccuuccuggugccccccaccguggagagcaagaccaagcccuucacccugcccauccugacccugggcgagcugagcaacagcagauuccccgcccccaucgacaugcuguacaccgaccccaacgagggcaucguggugcagccccagaacggcagaugcacccuggacggcacccugcagggcaccacccagcuggugcccacccagaucugcgccuucagaggcauccugaucggccagaccagcagaagccccgacagcgacagcaccgacagcgcccccagaagaagagaccacccccugcacaugcagcuggagaaccuggacggcacccaguacgaccccaccgacgaggugcccgccgcccugggcgccguggacuucaagggcaccaucuucggcguggccagccagagagacaccagcggcagccaggugggcgccaccagagcccacgaggugaucaucaacaccaccgaccccagauacacccccaagcugggcagcgugcugauguacagcgagagccaggacuucgagaccggccagcccaucagauucacccccaucggcaugggcgagaacgacuggcaccagugggagcugcccaacuacagcggcagacugacccugaacaugaaccuggcccccgccguggcccccgccuuccccggcgagagaauccuguucuucagaagcaucgugcccagcgccggcggcuacggcagcggccagauggacugccugcugccccaggaguggauccagcacuucuaccaggaggccgcccccagccagagcgccguggcccugaucagauacgugaaccccgacaccggcagaaacaucuucgaggccaagcugcacagagagggcuucaucaccguggccaacagcggcaacaaccccaucguggugccccccaacggcuacuucagauucgaggccugggugaaccaguucuacacccugacccccaugggcaccggccagggcagaagaagaaaccaguga

SEQ ID NO: 22330 - RNA, 1623 nt, Artificial Sequence; identical to SEQ ID NO: 22065
  derived and/or modified sequence opt4 from capsid_protein_VP1__Norovirus__AII02779

SEQ ID NO: 22331 - RNA, 1623 nt, Artificial Sequence; identical to SEQ ID NO: 22065
  derived and/or modified sequence opt4 from capsid_protein_VP1__Norovirus__AII02782

SEQ ID NO: 22332 - RNA, 1623 nt, Artificial Sequence
  derived and/or modified sequence opt4 from capsid_protein_VP1__Norovirus__AII02785
augaagauggccagcaacgacgccaaccccagcgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagaccaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagcaucaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacgccgcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22333 - RNA, 1647 nt, Artificial Sequence; identical to SEQ ID NO: 22283
  derived and/or modified sequence opt4 from capsid_protein_VP1__Norovirus__AII02788

SEQ ID NO: 22334 - RNA, 1647 nt, Artificial Sequence; identical to SEQ ID NO: 22283
  derived and/or modified sequence opt4 from capsid_protein_VP1__Norovirus__AII02791

SEQ ID NO: 22335 - RNA, 1623 nt, Artificial Sequence
  derived and/or modified sequence opt4 from capsid_protein_VP1__Norovirus__AII02794
augaagauggccagcagcgacgccaaccccagcgacggcagcaccgccagccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcagguggugcuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagagcuggaacagcuacgaccccaccgaggagauccccgccccccugggcagccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22336 - RNA, 1623 nt, Artificial Sequence; identical to SEQ ID NO: 22065
  derived and/or modified sequence opt4 from capsid_protein_VP1__Norovirus__AII02797

SEQ ID NO: 22337 - RNA, 1623 nt, Artificial Sequence; identical to SEQ ID NO: 22065
  derived and/or modified sequence opt4 from capsid_protein_VP1__Norovirus__AII02800

SEQ ID NO: 22338 - RNA, 1623 nt, Artificial Sequence; identical to SEQ ID NO: 22314
  derived and/or modified sequence opt4 from capsid_protein_VP1__Norovirus__AII02803

SEQ ID NO: 22339 - RNA, 1623 nt, Artificial Sequence; identical to SEQ ID NO: 22065
  derived and/or modified sequence opt4 from capsid_protein_VP1__Norovirus__AII02806

SEQ ID NO: 22340 - RNA, 1623 nt, Artificial Sequence; identical to SEQ ID NO: 22298
  derived and/or modified sequence opt4 from capsid_protein_VP1__Norovirus__AII02809

SEQ ID NO: 22341 - RNA, 1647 nt, Artificial Sequence; identical to SEQ ID NO: 22283
  derived and/or modified sequence opt4 from capsid_protein_VP1__Norovirus__AII02812

SEQ ID NO: 22342 - RNA, 1623 nt, Artificial Sequence
  derived and/or modified sequence opt4 from capsid_protein_VP1__Norovirus__AII02815
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucaucgugcagccccagaacggcagaugcaccaccgacggcgugcugcugggcaccacccagcugagccccgugaacaucugcaccuucagaggcgacgugacccacaucgccggcagcagagacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgaggcccaccagaacaccaaguucacccccgugggcgugauccaggacggcggcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22343 - RNA, 1647 nt, Artificial Sequence
  derived and/or modified sequence opt4 from capsid_protein_VP1__Norovirus__AII02818
augaagauggccagcaacgacgccgcccccagcaacgacggcgccgccggccuggugcccgagaucaacagcgaggccauggcccuggagcccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgccuucaccgccggcaagaucaucuucgccgccaucccccccaacuuccccaucgacaaccugagcgccgcccagaucaccaugugcccccacgugaucguggacgugagacagcuggagcccgugaaccugcccaugcccgacgugagaaacaacuucuuccacuacaaccagggcagcgacagcagacugagacugaucgccaugcuguacaccccccugagagccaacaacagcggcgacgacguguucaccgugagcugcagagugcugaccagacccagccccgacuucagcuucaacuuccuggugccccccaccguggagagcaagaccaagcccuucagccugcccauccugaccaucagcgagaugagcaacagcagauuccccgugcccaucgacagccugcacaccagccccaccgagaacaucguggugcagugccagaacggcagagugacccuggacggcgagcugaugggcaccacccagcugcugcccagccagaucugcgccuucagaggcaugcugaccagaagcaccagcagagccagcgaccaggccgacaccgugacccccagacuguucaacuacuacuggcacauccagcuggacaaccugaacggcacccccuacgaccccgccgaggacauccccggcccccugggcacccccgacuucagaggcaagguguucggcguggccagccagagaaaccccgacgccaccaccagagcccacgaggccaagaucgacaccaccagcggcagauucacccccaagcugggcagccuggagaucagcaccgagagcgacgacuucuaccagaaccagcccaccagauucacccccgugggcaucggcguggaccacgaggccgacuuccagcaguggacccugcccgacuacgccggccaguucacccacaacaugaaccuggcccccgccguggcccccaacuuccccggcgagcagcugcuguucuucagaagccagcugcccagcagcggcggcagaagcaacggcauccuggacugccuggugccccaggagugggugcagcacuucuaccaggagagcgcccccagccagacccagguggcccuggugagauacgugaaccccgacaccggcagagugcuguucgaggccaagcugcacaagcugggcuucaugaccaucgccaagaacggcgacagccccaucaccgugccccccaacggcuacuucagauucgagagcugggugaaccccuucuacacccuggcccccaugggcaccggcaacggcagaagaagaauccaguga

SEQ ID NO: 22344 - RNA, 1623 nt, Artificial Sequence
  derived and/or modified sequence opt4 from capsid_protein_VP1__Norovirus__AII02821
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucaucgugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcggcgcccccuucacccccaagcugggcagcgugcaguucagcaccgacaccgagaacgacuucgaggcccaccagaacaccaaguucacccccgugggcgugauccaggacggcggcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22345 - RNA, 1623 nt, Artificial Sequence; identical to SEQ ID NO: 22065
  derived and/or modified sequence opt4 from capsid_protein_VP1__Norovirus__AII02824

SEQ ID NO: 22346 - RNA, 1623 nt, Artificial Sequence; identical to SEQ ID NO: 22065
  derived and/or modified sequence opt4 from capsid_protein_VP1__Norovirus__AII02827

SEQ ID NO: 22347 - RNA, 1623 nt, Artificial Sequence; identical to SEQ ID NO: 22065
  derived and/or modified sequence opt4 from capsid_protein_VP1__Norovirus__AII02830

SEQ ID NO: 22348 - RNA, 1623 nt, Artificial Sequence
  derived and/or modified sequence opt4 from capsid_protein_VP1__Norovirus__AII02833
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucaucgugcagccccagaacggcagaugcaccaccgacggcgugcugcugggcaccacccagcugagccccgugaacaucugcaccuucagaggcggcgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgaggcccaccagaacaccaaguucacccccgugggcgugauccaggacggcggcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22349 - RNA, 1623 nt, Artificial Sequence
  derived and/or modified sequence opt4 from capsid_protein_VP1__Norovirus__AII02836
augaagauggccagcaacgacgccaaccccagcgacggcagcgccgccaaccuggugcccgaggugagcaacgaggugauggcccuggagcccguggccggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagaccaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22350 - RNA, 1623 nt, Artificial Sequence; identical to SEQ ID NO: 22139
  derived and/or modified sequence opt4 from capsid_protein_VP1__Norovirus__AII02839

SEQ ID NO: 22351 - RNA, 1623 nt, Artificial Sequence; identical to SEQ ID NO: 22147
  derived and/or modified sequence opt4 from capsid_protein_VP1__Norovirus__AII02842

SEQ ID NO: 22352 - RNA, 1647 nt, Artificial Sequence; identical to SEQ ID NO: 22283
  derived and/or modified sequence opt4 from capsid_protein_VP1__Norovirus__AII02845

SEQ ID NO: 22353 - RNA, 1647 nt, Artificial Sequence; identical to SEQ ID NO: 22283
  derived and/or modified sequence opt4 from capsid_protein_VP1__Norovirus__AII02848

SEQ ID NO: 22354 - RNA, 1623 nt, Artificial Sequence; identical to SEQ ID NO: 22098
  derived and/or modified sequence opt4 from capsid_protein_VP1__Norovirus__AII02851

SEQ ID NO: 22355 - RNA, 1623 nt, Artificial Sequence; identical to SEQ ID NO: 22065
  derived and/or modified sequence opt4 from capsid_protein_VP1__Norovirus__AII02854

SEQ ID NO: 22356 - RNA, 1623 nt, Artificial Sequence
  derived and/or modified sequence opt4 from capsid_protein_VP1__Norovirus__AII02857
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucaucgugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgaggcccaccagaacaccaaguucacccccgugggcgugauccaggacggcggcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagcccggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22357 - RNA, 1623 nt, Artificial Sequence; identical to SEQ ID NO: 22065
  derived and/or modified sequence opt4 from capsid_protein_VP1__Norovirus__AII02860

SEQ ID NO: 22358 - RNA, 1623 nt, Artificial Sequence; identical to SEQ ID NO: 22065
  derived and/or modified sequence opt4 from capsid_protein_VP1__Norovirus__AII02866

SEQ ID NO: 22359 - RNA, 1623 nt, Artificial Sequence
  derived and/or modified sequence opt4 from capsid_protein_VP1__Norovirus__AII02869
augaagauggccagcaacgacgccaaccccaccgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagaccaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22360 - RNA, 1623 nt, Artificial Sequence; identical to SEQ ID NO: 22065
  derived and/or modified sequence opt4 from capsid_protein_VP1__Norovirus__AII02872

SEQ ID NO: 22361 - RNA, 1623 nt, Artificial Sequence; identical to SEQ ID NO: 22065
  derived and/or modified sequence opt4 from capsid_protein_VP1__Norovirus__AII02875

SEQ ID NO: 22362 - RNA, 1647 nt, Artificial Sequence; identical to SEQ ID NO: 22283
  derived and/or modified sequence opt4 from capsid_protein_VP1__Norovirus__AII02878

SEQ ID NO: 22363 - RNA, 1623 nt, Artificial Sequence; identical to SEQ ID NO: 22065
  derived and/or modified sequence opt4 from capsid_protein_VP1__Norovirus__AII02881

SEQ ID NO: 22364 - RNA, 1623 nt, Artificial Sequence; identical to SEQ ID NO: 22065
  derived and/or modified sequence opt4 from capsid_protein_VP1__Norovirus__AII02884

SEQ ID NO: 22365 - RNA, 1647 nt, Artificial Sequence; identical to SEQ ID NO: 22283
  derived and/or modified sequence opt4 from capsid_protein_VP1__Norovirus__AII02887

SEQ ID NO: 22366 - RNA, 1623 nt, Artificial Sequence; identical to SEQ ID NO: 22147
  derived and/or modified sequence opt4 from capsid_protein_VP1__Norovirus__AII02890

SEQ ID NO: 22367 - RNA, 1623 nt, Artificial Sequence; identical to SEQ ID NO: 22100
  derived and/or modified sequence opt4 from capsid_protein_VP1__Norovirus__AII02893

SEQ ID NO: 22368 - RNA, 1623 nt, Artificial Sequence
  derived and/or modified sequence opt4 from capsid_protein_VP1__Norovirus__AII02896
augaagauggccagcaacgacgccaaccccagcgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugagagugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagaccaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagauccaccagaacaccaaguucacccccgugggcgugauccaggacggcggcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacagaagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22369 - RNA, 1647 nt, Artificial Sequence
  derived and/or modified sequence opt4 from capsid_protein_VP1__Norovirus__AII02899
augaagauggccagcaacgacgccgcccccagcaacgacggcgccgccggccuggugcccgagaucaacagcgaggccauggcccuggagcccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgccuucaccgccggcaagaucaucuucgccgccaucccccccaacuuccccaucgacaaccugagcgccgcccagaucaccaugugcccccacgugaucguggacgugagacagcuggagcccgugaaccugcccaugcccgacgugagaaacaacuucuuccacuacaaccagggcagcgacagcagacugagacugaucgccaugcuguacaccccccugagagccaacaacagcggcgacgacguguucaccgugagcugcagagugcugaccagacccagccccgacuucagcuucaacuuccuggugccccccaccguggagagcaagaccaagcccuucagccugcccauccugaccaucagcgagaugagcaacagcagauuccccgugcccaucgacagccugcacaccagccccaccgagaacaucguggugcagugccagaacggcagagugacccuggacggcgagcugaugggcaccacccagcugcugcccagccagaucugcgccuucagaggcaugcugaccagaagcaccagcagagccagcgaccaggccgacaccgccacccccagacuguucaacuacuacuggcacauccagcuggacaaccugaacggcacccccuacgaccccgccgaggacauccccggcccccugggcacccccgacuucagaggcaagguguucggcguggccagccagagaaaccccgacgccaccaccagagcccacgaggccaagaucgacaccaccagcggcagauucacccccaagcugggcagccuggagaucagcaccgagagcggcgacuucgaccagagccagcccaccagauucacccccgugggcaucggcguggaccacgaggccgacuuccagcaguggacccugcccgacuacgccggccaguucacccacaacaugaaccuggcccccgccguggcccccaacuuccccggcgagcagcugcuguucuucagaagccagcugcccagcagcggcggcagaagcaacggcauccuggacugccuggugccccaggagugggugcagcacuucuaccaggagagcgcccccagccagacccagguggcccuggugagauacgugaaccccgacaccggcagagugcuguucgaggccaagcugcacaagcugggcuucaugaccaucgccaagagcggcgacagccccaucaccgugccccccaacggcuacuucagauucgagagcugggugaaccccuucuacacccuggcccccaugggcaccggcaacggcagaagaagaauccaguga

SEQ ID NO: 22370 - RNA, 1623 nt, Artificial Sequence; identical to SEQ ID NO: 22065
  derived and/or modified sequence opt4 from capsid_protein_VP1__Norovirus__AII02902

SEQ ID NO: 22371 - RNA, 1647 nt, Artificial Sequence
  derived and/or modified sequence opt4 from capsid_protein_VP1__Norovirus__AIS24557
augaagauggccagcaacgacgccgcccccagcaacgacggcgccgccggccuggugcccgagaucaacaacgaggccauggcccuggaccccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgccuucaccgccggcaaggugaucuucgccgccaucccccccaacuuccccaccgacaaccugagcgccgcccagaucaccaugugcccccacgugaucguggacgugagacagcuggagcccaucaaccugcccaugcccgacgugagaaacaacuucuuccacuacaaccagggcagcgacagcagacugagacugaucgccaugcuguacaccccccugagagccaacaacagcggcgacgacguguucaccgugagcugcagagugcugaccagacccagccccgacuucagcuucaacuuccuggugccccccaccguggagagcaagaccaagcccuucacccugcccauccugaccaucagcgagaugagcaacagcagauuccccgugcccaucgacagccugcacaccagccccaccgacaacaucguggugcagugccagaacggcagagugacccuggacggcgagcugaugggcaccacccagcugcugcccagccagaucugcgccuucagaggcgugcugaccagaagcaccagcagagccagcgaccaggccgacgccgccacccccagacuguucaacuacuacuggcacauccagcuggacaaccugaacggcacccccuacgaccccgccgaggacauccccgccccccugggcacccccgacuucagaggcaagguguucggcguggccagccagagaaaccccgacagcaccaccagagcccacgaggccaagguggacaccaccagcggcagauucacccccaagcugggcagccuggagaucagcaccgagagcggcgacuucgaccagaaccagcccaccagauucacccccgugggcaucggcguggacaacgaggccgacuuccagcaguggacccugcccgacuacagcggccaguucacccacaacaugaaccuggcccccgccguggcccccaacuuccccggcgagcagcugcuguucuucagaagccagcugcccagcagcggcggcagaagcaacggcauccuggacugccuggugccccaggagugggugcagcacuucuaccaggagagcgcccccgcccagacccagguggcccuggugagauacgugaaccccgacaccggcagagugcuguucgaggccaagcugcacaagcugggcuacaugaccaucgccaagagcggcgacagccccaucaccgugccccccaacggcuacuucagauucgagagcugggugaaccccuucuacacccuggcccccaugggcaccggcaacggcagaagaagaauccaguga

SEQ ID NO: 22372 - RNA, 1620 nt, Artificial Sequence
  derived and/or modified sequence opt4 from capsid_protein_VP1__Norovirus__AIY30135
augagaaugagcgacggcgccgcccccaaggccgacggcagcgaggccagcggccaggaccuggugcccaccgccguggagcaggccgugcccauccagcccguggccggcgccgcccuggccgcccccgccgccggccagaucaaccagaucgaccccuggaucuuccagaacuucgugcagugcccccugggcgaguucagcaucagccccagaaacacccccggcgagauccuguucgaccuggcccugggccccggccugaaccccuaccuggcccaccugagcgccauguacaccggcugggugggcaacauggaggugcagcuggugcuggccggcaacgccuucaccgccggcaagguggugguggcccuggugccccccuacuuccccaagggcagccugaccaccgcccagaucaccugcuucccccacgugaugugcgacgugagaacccuggagcccauccagcugccccugcuggacgugagaagagugcuguggcacgccacccaggaccaggaggagagcaugagacuggugugcaugcuguacaccccccugagaaccaacagccccggcgacgagagcuucguggugagcggcagacugcugagcaagcccgccgccgacuucaacuucguguaccugaccccccccaucgagagaaccaucuacagaaugguggaccugcccgugauccagcccagacugugcacccacgccagauggcccgcccccguguacggccugcugguggaccccagccugcccagcaacccccaguggcagaacggcagagugcacguggacggcacccugcugggcaccacccccgugagcggcagcugggugagcugcuucgccgccgaggccgccuacgaguuccagagcggcaccggccagguggccaccuucacccugaucgagcaggacggcagcgccuacgugcccggcgacagagccgccccccugggcuaccccgacuucagcggccagcuggagaucgaggugcagaccgagaccaccaagaccggcgacaagcugaaggugaccaccuucgagaugauccugggccccaccaccaacguggaccaggcccccuaccagggcaagguguucgccagcaucaccgccgccgccagccuggaccugguggacggcagagugagagccgugcccagaagcaucuacggcuuccaggacgugauccccgaguacaacgacggccugcuggugccccuggccccccccaucggccccuuccugcccggcgaggugcugcugagauucagaaccuacaugagacagcuggacaccgccgacgccgccgccgaggccaucgacugcgcccugccccaggaguucaucagcugguucgccagcaacguguucaccgugcagagcgaggcccugcugcugagauacagaaacacccugaccggccagcugcuguucgagugcaagcuguacagcgagggcuacaucgcccugagcuacagcggcagcggcccccugaccuuccccaccgacggcuucuucgagguggugagcugggugcccagacuguaccagcuggccagcgugggcagccuggccaccggcagaacccuguga

SEQ ID NO: 22373 - RNA, 1623 nt, Artificial Sequence
  derived and/or modified sequence opt4 from capsid_protein_VP1__Norovirus__AKE07100
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccaucagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcauccccgugcugaccaucgaggagaugaccaacagcagauuccccaucccccuggagaagcuguucaccggccccagcagcgccuucguggugcagccccagaacggcagaugcagcaccgacggcgugcugcugggcaccacccagcugagccccgugaacaucugcaccuucagaggcgacgugacccacaucgccggcagccacaacuacaccaugaaccuggccagccagaacuggaacagcuacgaccccaccgaggagauccccgccccccugggcacccccgacuucgugggcaagauccagggcgugcugacccagaccaccagagccgacggcagcaccagaggccacaaggccaccgugcugaccggcagcgccaacuucacccccaagcugggcagaauccaguucgccaccgacaccgacaacgacuucgagaccaaccagaacaccaaguucacccccgugggcgugauccaggacggcgacaccgcccacagaaacgagccccagcagugggugcugcccagcuacagcggcagaaacacccacaacgugcaccuggcccccgccguggcccccaccuuccccggcgagcagcugcuguucuucagaagcaccauccccggcugcagcggcuaccccaacauggaccuggacugccugcugccccaggagugggugcaguucuucuaccaggaggccgcccccgcccagagcgacguggcccugcugagauucgugaaccccgacaccggcagagugcuguucgagugcaagcugcacaagagcggcuacaucaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22374 - RNA, 1623 nt, Artificial Sequence
  derived and/or modified sequence opt4 from capsid_protein_VP1__Norovirus__AKE07103
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagagccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaucgacggcgugcugcugggcaccacccagcugagccccgugaacaucugcaccuucagaggcgacgugacccacaucgccggcacccacaacuacaccaugaaccuggccacccagaacuggaacagcuacgaccccaccgaggagauccccgccccccugggcacccccgacuucgugggcaagauccagggcgugcugacccagaccaccaagaccgacggcagcaccagaggccacaaggccaccgugugcaucggcagcgccgacuucgcccccaagcugggcagagugcaguucgagaccgacaccaacaacgaccuggagaccaaccagaacaccaaguucacccccgugggcgugauccagaacggcgagaccgcccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggcagccacgaccuggugaucccccccaacggcuacuucagauucgacagcugggugaaccaguucuacacccuggcccccaugggcaacggcaccggcagaagaagagccaccuga

SEQ ID NO: 22375 - RNA, 1623 nt, Artificial Sequence
  derived and/or modified sequence opt4 from capsid_protein_VP1__Norovirus__AKE07106
augaagauggccagcagcgacgccaaccccagcgacggcagcaccgccaaccuggugcccgaggugaacgacgaggugauggcccuggagcccguggugggcgccgcccuggccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucaucguggacgugagacagcuggagcccgugcugaucccccugcccgacgccagaaacaacuucuaccacuacaaccagagcaacgagagcaccaucaagcugaucgccaugcuguacaccccccugagagccaacaacgccggcgacgacguguucaccgugagcugcagagugcugaccagacccagccuggacuucgacuucaucuuccuggugccccccaccguggagagcagaaccaagcccuucagcgugcccauccugaccguggaggagaugaccaacagcagauuccccaucccccuggagagacuguucaccggccccagcagcgccuucgccgugcagccccagaacggcagaugcaccaccgacggcgugcugcugggcaccacccagcugagccccgugaacaucugcaccuucagaggcgacgugacccacaccaccggcagccacaacuacaccaugaaccuggccagccagaacagaagcaacuacgaccccaccgaggagauccccgccccccugggcacccccgacuucgugggcaagauccagggcgcccugacccagaccaccagagccgacggcagcaccagaggccacaaggccaccguguacaccggcagcgccgacuucacccccaagcugggcagagugcaguucgccaccgacaccgaccacgacuucgacaccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggaguggguggcccacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22376 - RNA, 1719 nt, Artificial Sequence
  derived and/or modified sequence opt4 from capsid_protein_VP1__Norovirus__ALQ12260
augaagauggccagcaacggcgccgccgcccccagccaggacggcgccgccaaccuggugcccgagagccagcaggaggugcuggcccuggagcccguggccggcgccgcccuggccgcccccguggccggccaguucaacgccaucgaccccuggaucaagcagaacuucgugcaggcccccgccggcgaguucaccgugagccccagaaacgcccccggcgaggugcugauggaccuggagcugggccccgagaugaaccccuuccuggcccaccuggcccagauguacaacgccuacgccggcggcauggaggugcagaucauccuggccggcaacgccuucaccgccggcaagaucaucgugugcgccgugccccccaacuucccccccgacagacugagcgccagccaggccaccaacuucccccacgugaucauggacgugagaacccuggagcccguggugcugccccugcccgacgugagagccggcuucuuccacuacaaccagcugagagagcccagaaugagacugaugacccugcuguacaccccccugagagccaacggcaccggcgacgacgccuucaccgugagcugcagagugcugaccagacccaugcuggacuucgaguucauguuccuggugccccccaccguggagagcagagugacccccuucagcgugcccaccuaccccgugguggagaugaccaacagcagauggcccgccagaaucagcggcaugcacgugaacgccaaccagacccuggccgugcaguuccagaacggcagaugcacccuggacggccagcugaugggcaccacccagcugugcgccgccgacgugugcagaaugagaggcagauacaccagcaccagagccgaccccgccggccugggcugggaccuggacgccaccacccugguggacggccccgaggccagagugcaggccagaaucagcgugagcgcccaccugcagcuggaggagcugagcggccagcccuacgagguguacggcgagcagcccgccccccugggcacccccgacuuccagugcagacugaugggcgagcuggugagacugcccagcgccaaccccguggcccagagcagauucagagacgccuucuucgacaccuacggcgcccuguucgcccccgccgugggcagcgugaccgugaccgugaacaacagcagcagcagcgacuucgccaacgaccagcccuucgaguuccugcccaucggcguggagaucggcaacagcgccagauacgacgaguucgcccugcccagcuacaacggcgccaucggcgagaacagacaccuggcccccaucgccgcccccggcuuccccggcgagaaccugaucuucuucagcagcaaccugcccgugugggacagcaccagcgcccagagcaacagaagaaucagcugccugcugcccaacgaguucauccagcacuucuacgaccugcaggcccccagccagagcgacguggcccugcugagauacgugcaccccgagaccgacagauuccuguucgagugcaagcuguacagagacgccuuccugaccgugaacggcgccagcuacgccgaguuccccgugaacggcuacagcagauucgacagcugggugaagcaguucuucacccugagccccgugggcaccggcagcggcagaagaggcagaagcagaaaggcccaguga

SEQ ID NO: 22377 - RNA, 1620 nt, Artificial Sequence
  derived and/or modified sequence opt4 from capsid_protein_VP1__Norovirus__BAI49904
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaagagcagauuccccaucccccuggagaagcuguacaccggccccagcagcgccuucguggugcagccccagaacggcagaugcaccaccgacggcgugcugcugggcaccacccagcugagcguggugaacaucugcaccuucagaggcgacgugacccacaucgccggcagccacgacuacaccaugaaccuggccagccagaacuggaacaacuacgaccccaccgaggagauccccgccccccugggcacccccgacuucgugggcaagauccagggcaugcugacccagaccaccagagaggacggcagcaccagagcccacaaggccaccgugagcaccggcagcgugcacuucacccccaagcugggcagcgugcaguacaccaccgacaccaacaacgacuuccagaccggccagaacaccaaguucacccccgugggcgugauccaggacggcaacaaccaccagaacgagccccagcagugggugcugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagauuccuguucgagugcaagcugcacaagagcggcuacgugaccguggcccacaccggcccccacgaccuggugaucccccccaacggcuacuucagauucgacagcugggugaaccaguucuacacccuggcccccaugggcaacggcgccggcagaagaagagugcuguga

SEQ ID NO: 22378 - RNA, 1623 nt, Artificial Sequence
  derived and/or modified sequence opt4 from capsid_protein_VP1__Norovirus__BAI49905
augaagauggccagcaacgacgccagccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccagcaccagaaccuacagaaugaaccuggccagccagaacuggaacaacuacgaccccaccgaggagauccccgccccccugggcacccccgacuucgugggcaagauccagggcaugcugacccagaccaccaagggcgacggcagcaccagaggccacaaggccaccgugagcaccggcagcguggacuucacccccaagcugggcagcgugcaguucgccaccgacaccgacaacgacuucgagaccggccagaacaccagauucacccccgugggcgugauccaggacggcagcagcgcccacagaaacgagccccagcagugggugcugcccgacuacagcggcagaaccgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagaccggcuacgugaccguggcccacaccggccagcacgaccuggugaucccccccaacggcuacuucagauucgacagcugggugaaccaguucuacacccuggcccccaugggcaacggcgccggcagaagaagagcccuguga

SEQ ID NO: 22379 - RNA, 1623 nt, Artificial Sequence
  derived and/or modified sequence opt4 from capsid_protein_VP1__Norovirus__BAI49906
augaagauggccagcaacgacgccagccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcaccagaaccuacagaaugaaccuggccagccagaacuggaacaacuacgaccccaccgaggagauccccgccccccugggcacccccgacuucgugggcaagauccagggcaugcugacccagaccaccaagggcgacggcagcacccacggccacaaggccaccgugagcaccggcagcguggacuucacccccaagcugggcagcgugcaguucgccaccgacaccgacaacgacuucgagaccggccagaacaccagauucacccccgugggcgugauccaggacggcagcagcgcccacagaaacgagccccagcagugggugcugcccgacuacagcggcagaaccgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagaccggcuacgugaccguggcccacaccggccagcacgaccuggugaucccccccaacggcuacuucagauucgacagcugggugaaccaguucuacacccuggcccccaugggcaacggcgccggcagaagaagagcccuguga

SEQ ID NO: 22380 - RNA, 1623 nt, Artificial Sequence
  derived and/or modified sequence opt4 from capsid_protein_VP1__Norovirus__BAI49907
augaagauggccagcaacgacgccagccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcaccagaaccuacagaaugaaccuggccagccagaacuggaacaacuacgaccccaccgaggagauccccgccccccugggcacccccgacuucgugggcaagauccagggcgugcugacccagaccaccagaggcgacggcagcaccagaggccacaaggccaccgugagcaccggcagcguggacuucacccccaagcugggcagcgugcaguucgccaccgacaccgacaacgacuucgagaccggccagaacaccagauucacccccgugggcgugauccaggacggcagcagcgcccacagaaacgagccccagcagugggugcugcccgacuacagcggcagaaccgugcacaacgugcaccuggcccccgccguggcccccaccuuccccggcgagcagcugcuguucuucagauucaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagaccggcuacgugaccguggcccacaccggccagcacgaccuggugaucccccccaacggcuacuucagauucgacagcugggugaaccaguucuacacccuggcccccaugggcaacggcgccggcagaagaagagcccuguga

SEQ ID NO: 22381 - RNA, 1623 nt, Artificial Sequence
  derived and/or modified sequence opt4 from capsid_protein_VP1__Norovirus__BAI49909
augaagauggccagcaacgacgccacccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaaccuacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccagaacuacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcgugcacuucacccccaagcugggcagcgugcaguucagcaccgacaccagcaacgacuucgagaccggccagaacaccagauucacccccgugggcguggugcaggacggcagcaccacccaccagaacgagccccagcagugggugcugcccaacuacagcggcagagacagccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggagagcgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagagcccuguga

SEQ ID NO: 22382 - RNA, 1623 nt, Artificial Sequence
  derived and/or modified sequence opt4 from capsid_protein_VP1__Norovirus__BAI49910
augaagauggccagcaacgacgccacccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccagaacuacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcgugcacuucacccccaagcugggcagcgugcaguucagcaccgacaccagcaacgacuucgagaccggccagaacaccagauucacccccgugggcguggugcaggacggcagcaccacccaccagaacgagccccagcagugggugcugcccaacuacagcggcagagacagccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggagagcgcccccgcccagagcgacguggcccugcugagauucgugaaccccgacaccggcagagugcuguucgagugcgagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagagcccuguga

SEQ ID NO: 22383 - RNA, 1623 nt, Artificial Sequence
  derived and/or modified sequence opt4 from capsid_protein_VP1__Norovirus__BAI49911
augaagauggccagcaacgacgccagccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcaccagaaccuacagaaugaaccuggccagccagaacuggaacaacuacgaccccaccgaggagauccccgccccccugggcacccccgacuucgugggcaagauccagggcaugcugacccagaccaccagaggcgacggccugaccagaggccacaaggccaccgugagcaccggcagcguggacuucacccccaagcugggcagcgugcaguucgccaccgacaccgacaacgacuucgagaccggccagaacaccagauucacccccgugggcgugauccaggacggcagcagcgcccacagaaacgagccccagcagugggugcugcccgacuacagcggcagaaccgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucguggaccccgacaccggcagagugcuguucgagugcaagcugcacaagaccggcuacgugaccguggcccacaccggccagcacgaccuggugaucccccccaacggcuacuucagauucgacagcugggugaaccaguucuacacccuggcccccaugggcaacggcgccggcagaagaagagcccuguga

SEQ ID NO: 22384 - RNA, 1623 nt, Artificial Sequence
  derived and/or modified sequence opt4 from capsid_protein_VP1__Norovirus__BAI49912
augaagauggccagcaacgacgccagccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcaccagaaccuacagaaugaaccuggccagccagaacuggaacaacuacgaccccaccgaggagauccccgccccccugggcacccccgacuucgugggcagaauccagggcaugcugacccagaccaccaagggcgacggcagcaccagaggccacaaggccaccgugagcaccggcagcguggacuucacccccaagcugggcagcgugcaguucgccaccgacaccgacaacgacuucgagaccggccagaacaccagauucacccccgugggcgugauccaggacggcagcagcgcccugagaaacgagccccagcagugggugcugcccgacuacagcggcagaaccgugcacaacgugcaccuggcccccgccguggcccugaccuuccccggcgagcagcugcuguucuucagaagcaccaugcccggcugcagcggcuaccccaacauggaccuggacugccugcugccccaggagugggugcagcacuucuaccaggaggccgcccccagccagagcgacguggcccugcugagauucgugaaccccgacaccggcagagugcuguucgagugcaagcugcacagagccggcuacgugaccguggcccacaccggccagcacgaccuggugaucccccccaacggcuacuucagauucgacagcugggugaaccaguucuacacccuggcccccaugggcaacggcgccggcagaagaagagcccuguga

SEQ ID NO: 22385 - RNA, 1623 nt, Artificial Sequence
  derived and/or modified sequence opt4 from capsid_protein_VP1__Norovirus__BAI49914
augaagauggccagcaacgacgccagccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcaccagaaccuacagaaugaaccuggccagccagaacuggaacaacuacgaccccaccgaggagauccccgccccccugggcacccccgacuucgugggcaagauccagggcaugcugacccagaccaccaagggcgacggcagcaccagaggccacaaggccaccgugagcaccggcagcguggacuucacccccaagcugggcagcgugcaguucgccaccgacaccgacaacgacuucgagaccggccagaacaccagauucacccccgugggcgugauccaggacggcagcagcacccacagaaacgagccccagcagugggugcugcccgacuacagcggcagaaccgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccagccagagcgacguggcccugcugagauucgugaaccccgacaccggcagagugcuguucgagugcaagcugcacaaggccggcuacgugaccguggcccacaccggccagcacgaccuggugaucccccccaacggcuacuucagauucgacagcugggugaaccaguucuacacccuggcccccaugggcaacggcgccggcagaagaagagcccuguga

SEQ ID NO: 22386 - RNA, 1623 nt, Artificial Sequence
  derived and/or modified sequence opt4 from capsid_protein_VP1__Norovirus__BAI49916
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggccugcugacccagaccaccaagggcgacggcagcaccagaggccacaaggccaccguguacaccggcagcgcccccuucacccccaagcugggcggcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22387 - RNA, 1623 nt, Artificial Sequence
  derived and/or modified sequence opt4 from capsid_protein_VP1__Norovirus__BAI49917
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggaggugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcaccagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugaugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22388 - RNA, 1623 nt, Artificial Sequence
  derived and/or modified sequence opt4 from capsid_protein_VP1__Norovirus__BAI49918
augaagauggccagcaacgacgccaaccccagcgacggcagcgccgccaaccuggugcccgaggugaacaacgaggugauggcccuggagcccguggccggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcaccagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugaugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22389 - RNA, 1623 nt, Artificial Sequence
  derived and/or modified sequence opt4 from capsid_protein_VP1__Norovirus__BAI49919
augaagauggccagcaacgacgccaaccccagcgacggcagcgccgccaaccuggugcccgaggugaacaacgaggugauggcccuggagcccguggugggcgccgccaucgccgcccccguggccggccagcagaacaucaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcaccagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugaugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22390 - RNA, 1623 nt, Artificial Sequence
  derived and/or modified sequence opt4 from capsid_protein_VP1__Norovirus__BAI49920
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagcugaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccggcuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22391 - RNA, 1623 nt, Artificial Sequence
  derived and/or modified sequence opt4 from capsid_protein_VP1__Norovirus__BAI49921
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucaucgacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccuggacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcacccugagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22392 - RNA, 1623 nt, Artificial Sequence
  derived and/or modified sequence opt4 from capsid_protein_VP1__Norovirus__BAI49923
augaagauggccagcaacgacgccaaccccagcgacggcagcgccgccaaccuggugcccgaggugaacaacgaggugauggcccuggagcccguggugggcgccgccaucgccgcccccguggccggccagaccaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22393 - RNA, 1623 nt, Artificial Sequence
  derived and/or modified sequence opt4 from capsid_protein_VP1__Norovirus__BAI49924
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaucaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccagauucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagugcuguga

SEQ ID NO: 22394 - RNA, 1623 nt, Artificial Sequence
  derived and/or modified sequence opt4 from capsid_protein_VP1__Norovirus__BAI49925
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaagcgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccagauucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagugcuguga

SEQ ID NO: 22395 - RNA, 1623 nt, Artificial Sequence
  derived and/or modified sequence opt4 from capsid_protein_VP1__Norovirus__BAI49926
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccugaccagccugaacuggaacaacuacgaccccaccgaggagauccccgccccccugggcacccccgacuucgugggcaagauccagggccugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcaucaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22396 - RNA, 1623 nt, Artificial Sequence
  derived and/or modified sequence opt4 from capsid_protein_VP1__Norovirus__BAI49927
augaagauggccagcaacgacgccaaccccagcgacggcagcgccgccaaccuggugcccgaggugaacaacgaggugauggcccuggagcccguggugggcgccgccaucgccgcccccguggccggccagaccaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22397 - RNA, 1623 nt, Artificial Sequence
  derived and/or modified sequence opt4 from capsid_protein_VP1__Norovirus__BAI49928
augaagauggccagcaacgacgccaaccccagcgacggcagcgccgccaaccuggugcccgaggugaacaacgaggugauggcccuggagcccguggugggcgccgccaucgccgcccccguggccggccagaccaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccugaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22398 - RNA, 1620 nt, Artificial Sequence
  derived and/or modified sequence opt4 from capsid_protein_VP1__Norovirus__BAJ25070
augaagauggccagcagcgacgccgcccccagcaacgacggcgccaccggccuggugcccgagaucaacaccgagacccugccccuggagcccguggccggcgccgccaucgccgcccccgugaccggccagaacaacaucaucgaccccuggaucagaaacaacuucgugcaggcccccaacggcgaguucaccgugagccccagaaacagccccggcgagauccugaugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggacaugcugagccccgcccagaucaccaugcugccccaccugaucguggacgugagaacccuggagcccaucaugaucccccugcccgacgugagaaacguguucuaccacuacaacaaccagcccgcccccagaaugagacugguggccaugcuguacaccccccugagaagcaacggcagcggcgaggacguguucaccgugagcugcagagugcugaccagacccacccccgacuucgaguucaccuaccuggugccccccagcguggagagcaagaccaagcccuucagccugcccauccugaccaucggcgagcugaccaacagcagauuccccgcccccaucgaccagcuguucaccagcaccaacaacgacgugguggugcagccccagaacggcagaugcacccuggacggcgagcugcagggcaccacccagcugcugagcaccgccaucugcagcuacagaggcaccaccagcaaccccaucgacgacugggacgaccaccugcugcaccugacccaccccaacggcgccaccuacgaccccaccgaggacgugcccgcccccuucggcacccaggacuuccagggcauccuguacggcaugcugacccagaacccccagaccggcggcggcgaggccgccaacagcagaggcguguacaucagcagcaccagcgacaaguucacccccaagcugggcaccaucggccugcaccacgugcagggcggcgacguggccaacaaccagaagagcaaguucacccccaucggcaucgccgagaacggcaacacccccuucagacagugggugcugcccaacuacagcggcagacugacccugaacaccaaccuggcccccgccgugggccccaacuuccccggcgagcagauccuguucuucagaagcaacgugcccagcgugcagggcggccacagcaucgagaucgacugccugaucccccaggaguggaucagccacuucuaccaggagagcgcccccagccagagcgacguggcccugaucagauacgugaaccccgacaccggcagaacccuguucgaggccaagcugcacagacagggcuucaucaccaucgccaccaccggcaacaaccccgugguggugccccccaacggcuacuucagauucgacagcugggugaaccaguucuacgcccuggcccccaugggcaccggcaacggcagaagaagagugcaguga

SEQ ID NO: 22399 - RNA, 1620 nt, Artificial Sequence
  derived and/or modified sequence opt4 from capsid_protein_VP1__Norovirus__BAJ25072
augaagauggccagcaacgacgccgcccccagcaacgacggcgccaccggccuggugcccgagaucaacaccgagacccugccccuggagcccguggccggcgccgccaucgccgcccccgugaccggccagaacaacaucaucgaccccuggaucagaaccaacuucgugcaggcccccaacggcgaguucaccgugagccccagaaacagccccggcgagauccugaugaaccuggagcugggccccgaccugaaccccuaccuggcccaccuggccagaauguacaacggcuacgccggcggcguggaggugcaggugcugcuggccggcaacgccuucaccgccggcaagauccuguucgccgccgugccccccaacuuccccguggacaugcugagccccgcccagaucaccaugcugccccaccugaucguggacgugagaacccuggagcccaucaugaucccccugcccgacgugagaaacguguucuaccacuacaacaaccagcccgcccccagaaugagacugguggccaugcuguacaccccccugagaagcaacggcagcggcgaggacguguucaccgugagcugcagagugcugaccagacccacccccgacuucgaguucaccuaccuggugccccccagcguggagagcaagaccaagcccuucagccugcccauccugaccaucggcgagcugaccaacagcagauuccccgcccccaucgaccagcuguucaccagcaccaacaacgacgugguggugcagccccagaacggcagaugcacccuggacggcgagcugcagggcaccacccagcugcugagcaccgccgugugcagcuacagaggcaccaccagcaaccccaucgacgacugggacgaccaccugcugcaccugacccaccccaacggcgccaccuacgaccccaccgaggacgugcccgcccccuucggcacccaggacuuccagggcauccuguacggcaugcugacccagaacccccaggccggcggcggcgaggccgccagcagcagaggcguguacaucagcagcaccagcgacaaguucacccccaagcugggcaccaucggccugcacagagugcagggcggcgccguggccgacaaccagaagagcaaguucacccccaucggcaucgccgagaacgacaacacccccuucagacagugggugcugcccaacuacagcggcagacugacccugaacaccaaccuggcccccgccgugggccccaacuuccccggcgagcagauccuguucuucagaagcaacgugcccagcgugcagggcggccacagcaucgagaucgacugccugaucccccaggagugggugagccacuucuaccaggagagcgcccccagccagagcgacguggcccugaucagauacgugaaccccgacaccggcagaacccuguucgaggccaagcugcacagacagggcuucaucaccaucgccaccaccggcaacaaccccgugguggugccccccaacggcuacuucagauucgacagcugggugaaccaguucuacgcccuggcccccaugggcaccggcaacggcagaagaagagugcaguga

SEQ ID NO: 22400 - RNA, 1608 nt, Artificial Sequence
  derived and/or modified sequence opt4 from capsid_protein_VP1__Norovirus__BAJ25076
augaagauggccagcaacgacgccaaccccagcagcgacggcagcgccaaccuggugcccgagaucagcaacgaggugauggcccuggagcccguggccggcgccgccaucgccgcccccguggccggccagcagaacaucaucgaccccuggaucagaaacaacuucgugcaggcccccggcggcgaguucaccgugagccccagaaacgcccccggcgaggugcugcugaaccugccccugagccccgacaucaaccccuaccuggcccaccugagcagaauguacaacggcuacgccggcggcguggagguggagguggugcuggccggcaacgccuucaccgccggcaagaucaucuucgccgccgugccccccaacuucccccccgagaaccugagccccagccagaucaccaugcugccccacaucaucguggacgugagacagcuggagcccgugagaaucccccugcccgacgugagaaacaacuucuaccacuacagcagagagaacgacagcacccugagacugaucgccaugcuguacaccccccugagagccaacaacgccggcgacgacguguucaccgugagcugcagagugcugaccagacccagccccgacuucgacuucaucuuccuggugccccccaccguggagagcaagagcaagcccuucaccauccccaugcugaccaucgaggagaugaccaacagcagauuccccgccccccuggagcugaugaccaccggccccagccacgacaucguggugcagccccagaacggcagaugcaccaucgacggcgugcugcugggcaccacccagcugagccccgugaacaucugcagccugagaggcgugcccaccaagagaaccaacggcaacgacaacugcuucgugcagcuggagaaccccaacggcagcgccuacgaccccaccgaggacauccccgccgugcugggcagccccgacuucgugggcgagcuguacggcaccaucacccagagaagcagcgacaacagcaccagagcccaccccuucacccugaacaccggcagccccagauacacccccaagaucggcagcguggacaucagagugaccgacgugagcgaccugcaggaccacgaccccgugaagcugacccccgugggccugagcggcgacagaggcagcauccaccaguggcagcugcccaacuacagcggcguggccacccacaacaugcaccuggcccccagcguggccccccuguuccccggcgagcagauccuguucuucagaagcaccgugcccggcugcggcggcuaccccaacagcaacaucgacugccugaucccccaggagugggugcagcacuucuaccaggagggcgcccccgccagaaccgacguggcccugcugagauucaucaaccccgacaccggcagagugcuguucgagugcaagcugcacaagcacggcuucaucaccguggccuacagcggcaaccacgaccuggugaugccccccaacggcuacuucagauucgagagcugggugaaccaguuccacacccuggcccccaugggcaccggcagcggcagaagaagaauccaguga

SEQ ID NO: 22401 - RNA, 1644 nt, Artificial Sequence
  derived and/or modified sequence opt4 from capsid_protein_VP1__Norovirus__BAN16283
augaagauggccagcagcgacgccgcccccagcaacgacggcgccgccaaccuggugcccgaggccaacaacgaggugauggcccuggagcccguggugggcgccagcaucgccgcccccguggugggccagcagaacaucaucgaccccuggaucagagagaacuucgugcaggccccccagggcgaguucaccgugagccccagaaacagccccggcgagaugcugcugaaccuggagcugggccccgagcugaaccccuaccugagccaccugagcagaauguacaacggcuacgccggcggcaugcaggugcagguggugcuggccggcaacgccuucaccgccggcaagaucaucuucgccgccgugcccccccacuuccccguggagaacaucagcgccgcccagaucaccaugugcccccacgugaucguggacgugagacagcuggagcccgugcugcugccccugcccgacaucagaaacagauucuuccacuacaaccaggagaacacccccagaaugagacugguggccaugcuguacaccccccugagagccaacagcggcgaggacguguucaccgugagcugcagagugcugaccagacccgcccccgacuucgaguucaccuuccuggugccccccaccguggagagcaagaccaagcccuucacccugcccauccugacccugggcgagcugagcaacagcagauuccccgcccccaucgacaugcuguacaccgaccccaacgagggcaucguggugcagccccagaacggcagaugcacccuggacggcacccugcagggcaccacccagcuggugcccacccagaucugcgccuucagaggcacccugaucggccagaccagcagaagcagcgacagcaccgacagcgcccccagaagaagagaccacccccugcacgugcagcugaagaaccuggacggcacccaguacgaccccaccgacgaggugcccgccgugcugggcgccaucgacuucaagggcaccguguucggcguggccagccagagagacgugagcggcgaccaggugggcgccaccagagcccacgaggugcacaucaacaccaccgaccccagauacacccccaagcugggcagcauccugaugcacagcgagagcggcgacuucgugaccggccagcccgugagauucacccccaucggcaugggcgacaacgacuggcaccagugggagcugcccgacuacagcggccaccugacccugaacaugaaccuggcccccgccguggcccccgccuuccccggcgagagaauccuguucuucagaagcaucgugcccagcgccggcggcuacggcaccggccagaucgacugccugaucccccaggagugggugcagcacuucuaccaggaggccgcccccagccagagcgccguggcccugaucagauacgugaaccccgacaccggcagaaacaucuucgaggccaagcugcacagagagggcuucaucaccguggccaacagcggcaacaaccccaucguggugccccccaacggcuacuucagauucgaggccugggugaaccaguucuacacccugacccccaugggcaccggccagggcagaagaagaaaccaguga

SEQ ID NO: 22402 - RNA, 1644 nt, Artificial Sequence
  derived and/or modified sequence opt4 from capsid_protein_VP1__Norovirus__BAN16285
augaagauggccagcaacgacgccgcccccagcaacgacggcgccgccaaccuggugcccgaggccaacaacgaggugauggcccuggagcccguggugggcgccagcaucgccgcccccguggugggccagcagaacaucaucgaccccuggaucagagagaacuucgugcaggccccccagggcgaguucaccgugagccccagaaacagccccggcgagaugcugcugaaccuggagcugggccccgagcugaaccccuaccugagccaccugagcagaauguacaacggcuacgccggcggcaugcaggugcagguggugcuggccggcaacgccuucaccgccggcaagaucaucuucgccgccgugcccccccacuuccccguggagaacaucagcgccgcccagaucaccaugugcccccacgugaucguggacgugagacagcuggagcccgugcugcugccccugcccgacaucagaaacagauucuuccacuacaaccaggagaacacccccagaaugagacugguggccaugcuguacaccccccugagagccaacagcggcgaggacguguucaccgugagcugcagagugcugaccagacccgcccccgacuucgaguucaccuuccuggugccccccaccguggagagcaagaccaagcccuucacccugcccauccugacccugggcgagcugagcaacagcagauuccccgcccccaucgacaugcuguacaccgaccccaacgagggcaucguggugcagccccagaacggcagaugcacccuggacggcacccugcagggcaccacccagcuggugcccacccagaucugcgccuucagaggcacccugaucggccagaccagcagaagcagcgacagcaccgacagcgcccccagaagaagagaccacccccugcacgugcagcugaagaaccuggacggcacccaguacgaccccaccgacgaggugcccgccgugcugggcgccaucgacuucaagggcaccguguucggcguggccagccagagagacgugagcggccagcaggugggcgccaccagagcccacgaggugcacaucaacaccaccgaccccagauacacccccaagcugggcagcauccugaugcacagcgagagcgacgacuucgugaccggccagcccgugagauucacccccaucggcaugggcgacaacgacuggcaccagugggagcugcccgacuacagcggccaccugacccugaacaugaaccuggcccccgccguggcccccgccuuccccggcgagagaauccuguucuucagaagcauggugcccagcgccggcggcuacggcagcggccagaucgacugccugaucccccaggagugggugcagcacuucuaccaggaggccgcccccagccagagcgccguggcccugaucagauacgugaaccccgacaccggcagaaacaucuucgaggccaagcugcacagagagggcuucaucaccguggccaacagcggcaacaaccccaucguggugccccccaacggcuacuucagauucgaggccugggugaaccaguucuacacccugacccccaugggcaccggccagggcagaagaagaaaccaguga

SEQ ID NO: 22403 - RNA, 1644 nt, Artificial Sequence
  derived and/or modified sequence opt4 from capsid_protein_VP1__Norovirus__BAN16287
augaagauggccagcaacgacgccgcccccagcaacgacggcgccgccaaccuggugcccgaggccaacaacgaggugauggcccuggagcccguggccggcgccagcaucgccgcccccguggugggccagcagaacaucaucgaccccuggaucagagagaacuucgugcaggccccccagggcgaguucaccgugagccccagaaacagccccggcgagaugcugcugaaccuggagcugggccccgagcugaaccccuaccugagccaccugagcagaauguacaacggcuacgccggcggcaugcaggugcagguggugcuggccggcaacgccuucaccgccggcaagaucaucuucgccgccgugcccccccacuuccccgugaagaacaucagcgccgcccagaucaccaugugcccccacgugaucguggacgugagacagcuggagcccgugcugcugccccugcccgacaucagaaacagauucuuccacuacaaccaggagaacacccccagaaugagacugguggccaugcuguacaccccccugagagccaacagcggcgaggacguguucaccgugagcugcagagugcugaccagacccgcccccgacuucgaguucaccuuccuggugccccccaccguggagagcaagaccaagcccuucacccugcccauccugacccugggcgagcugagcaacagcagauuccccgcccccaucgacaugcuguacaccgaccccaacgagggcaucguggugcagccccagaacggcagaugcacccuggacggcacccugcagggcaccacccagcuggugcccacccagaucugcgccuucagaggcacccugaucggccagaccagcagaagcagcgacagcaccgacagcgcccccagaagaagagaccacccccugcacgugcagcugaagaaccuggacggcacccaguacgaccccaccgacgaggugcccgccgugcugggcgccaucgacuucaagggcaccguguucggcguggccagccagagagacgugagcggccagcaggugggcgccaccagagcccacgaggugcacaucaacaccaccgaccccagauacacccccaagcugggcagcauccugauccacagcgagagcgacgacuucgugaccggccagcccgugagauucacccccaucggcaugggcgacaacgacuggcaccagugggagcugcccgacuacagcggccaccugacccugaacaugaaccuggcccccgccguggcccccgccuuccccggcgagagaauccuguucuucagaagcauggugcccagcgccggcggcuacggcagcggccagaucgacugccugaucccccaggagugggugcagcacuucuaccaggaggccgcccccagccagagcgccguggcccugaucagauacgugaaccccgacaccggcagaaacaucuucgaggccaagcugcacagagagggcuucaucaccguggccaacagcggcaacaaccccaucguggugccccacaacggcuacuucagauucgaggccugggugaaccaguucuacacccugacccccaugggcaccggccagggcagaagaagaaaccaguga

SEQ ID NO: 22404 - RNA, 1644 nt, Artificial Sequence
  derived and/or modified sequence opt4 from capsid_protein_VP1__Norovirus__BAN16289
augaagauggccagcaacgacgccgcccccagcaacgacggcgccgccaaccuggugcccgaggccaacaacgaggugauggcccuggagcccguggugggcgccagcaucgccgcccccguggugggccagcagaacaucaucgaccccuggaucagagagaacuucgugcaggccccccagggcgaguucaccgugagccccagaaacagccccggcgagaugcugcugaaccuggagcugggccccgagcugaaccccuaccugagccaccugagcagaauguacaacggcuacgccggcggcaugcaggugcagguggugcuggccggcaacgccuucaccgccggcaagaucaucuucgccgccgugcccccccacuuccccguggagaacaucagcgccgcccagaucaccaugugcccccacgugaucguggacgugagacagcuggagcccgugcugcugccccugcccgacaucagaaacagauucuuccacuacaaccaggagaacacccccagaaugagacugguggccaugcuguacaccccccugagagccaacagcggcgaggacguguucaccgugagcugcagagugcugaccagacccgcccccgacuucgaguucaccuuccuggugccccccaccguggagagcaagaccaagcccuucacccugcccauccugacccugggcgagcugagcaacagcagauuccccgcccccaucgacaugcuguacaccgaccccaacgagggcaucguggugcagccccagaacggcagaugcacccuggacggcacccugcagggcaccacccagcuggugcccacccagaucugcgccuucagaggcacccugaucggccagaccagcagaagcagcgacagcaccgacagcgcccccagaagaagagaccacccccugcacgugcagcugaagaaccuggacggcacccaguacgaccccaccgacgaggugcccgccgugcugggcgccaucgacuucaagggcaccgugcugggcguggccagccagagagacgugagcggccagcaggugggcgccaccagagcccacgaggugcacaucaacaccaccgaccccagauacacccccaagcugggcagcauccugaugcacagcgagagcgacgacuucgugaccggccagcccgugagauucacccccaucggcaugggcgacaacgacuggcaccagugggagcugcccgacuacagcggccaccugacccugaacaugaaccuggcccccgccguggcccccgccuuccccggcgagagaauccuguucuucagaagcaucgugcccagcgccggcggcuacggcagcggccagaucgacugccugaucccccaggagugggugcagcacuucuaccaggaggccgcccccagccagagcgccguggcccugaucagauacgugaaccccgacaccggcagaaacaucuucgaggccaagcugcacagagagggcuucaucaccguggccaacagcggcaacaaccccaucguggugccccccaacggcuacuucagauucgaggccugggugaaccaguucuacacccugacccccaugggcaccggccagggcagaagaagaaaccaguga

SEQ ID NO: 22405 - RNA, 1644 nt, Artificial Sequence
  derived and/or modified sequence opt4 from capsid_protein_VP1__Norovirus__BAN16291
augaagauggccagcaacgacgccgcccccagcaacgacggcgccgccaaccuggugcccgaggccaacaacgaggugauggcccuggagcccguggugggcgccagcaucgccgcccccguggugggccagcagaacaucaucgaccccuggaucagagagaacuucgugcaggccccccagggcgaguucaccgugagccccagaaacagccccggcgagaugcugcugaaccuggagcugggccccgagcugaaccccuaccugagccaccugagcagaauguacaacggcuacgccggcggcaugcaggugcagguggugcuggccggcaacgccuucaccgccggcaagaucaucuucgccgccgugcccccccacuuccccguggagaacaucagcgccgcccagaucaccaugugcccccacgugaucguggacgugagacagcuggagcccgugcugcugccccugcccgacaucagaaacagauucuuccacuacaaccaggaggacacccccagaaugagacugguggccaugcuguacaccccccugagagccaacagcggcgaggacguguucaccgugagcugcagagugcugaccagacccgcccccgacuucgaguucaccuuccuggugccccccaccguggagagcaagaccaagcccuucacccugcccauccugacccugggcgagcugagcaacagcagauuccccgcccccaucgacaugcuguacaccgaccccaacgagaccaucguggugcagccccagaacggcagaugcacccuggacggcacccugcagggcaccacccagcuggugcccacccagaucugcagcuucagaggcacccugaucagccagaccagcagaagcgccgacagcaccgacagcgcccccagagugagaaaccacccccugcacgugcagaugaagaaccuggacggcacccccuacgaccccaccgacgaggugcccgccgugcugggcgccaucgacuucaagggcaccguguucggcguggccagccagagaaacaccaccggcaacagcgugggcgccaccagagcccacgaggugcacaucgacaccaccaaccccagauacacccccaagcugggcagcgugcugaugaacagcgagagcagcgacuucgacgacggccagcccaucagauucacccccaucggcaugggcgccgacgacuggcaccagugggagcugcccgaguacagcggccaccugacccugaacaugaaccuggcccccgccguggcccccgccuuccccggcgagagaauccuguucuucagaagcguggugcccagcgccggcggcuacggcagcggccagaucgacugccugaucccccaggagugggugcagcacuucuaccaggaggccgcccccagccagagcgccguggcccugaucagauacgugaaccccgacaccggcagaaacaucuucgaggccaagcugcacagagagggcuucaucaccguggccaacagcggcaacaaccccaucguggugccccccaacggcuacuucagauucgaggccugggugaaccaguucuacacccugacccccaugggcaccggccagggcagaagaagagugcaguga

SEQ ID NO: 22406 - RNA, 1644 nt, Artificial Sequence
  derived and/or modified sequence opt4 from capsid_protein_VP1__Norovirus__BAN16293
augaagauggccagcaacgacgccgcccccagcaacgacggcgccgccaaccuggugcccgaggccaacaacgaggugauggcccuggagcccguggugggcgccagcaucgccgcccccguggugggccagcagaacaucaucgaccccuggaucagagagaacuucgugcaggccccccagggcgaguucaccgugagccccagaaacagccccggcgagaugcugcugaaccuggagcugggccccgagcugaaccccuaccugagccaccugagcagaauguacaacggcuacgccggcggcaugcaggugcagguggugcuggccggcaacgccuucaccgccggcaagaucaucuucgccgccgugcccccccacuuccccguggagaacaucagcgccgcccagaucaccaugugcccccacgugaucguggacgugagacagcuggagcccgugcugcugccccugcccgacaucagaaacagauucuuccacuacaaccaggaggacacccccagaaugagacugguggccaugcuguacaccccccugagagccaacagcggcgaggacguguucaccgugagcugcagagugcugaccagacccgcccccgacuucgaguucaccuuccuggugccccccaccguggagagcaagaccaagcccuucacccugcccauccugacccugggcgagcugagcaacagcagauuccccgcccccaucgacaugcuguacaccgaccccaacgagaccaucguggugcagccccagaacggcagaugcacccuggacggcacccugcagggcaccacccagcuggugcccacccagaucugcagcuucagaggcacccugaucagccagaccagcagaagcgccgacagcaccgacagcgcccccagagugagaaaccacccccugcacgugcagcugaagaaccuggacggcacccccuacgaccccaccgacgaggugcccgccgugcugggcgccaucgacuucaagggcaccguguucggcguggccagccagagaaacaccaccggcaacagcgugggcgccaccagagcccacgaggugcacaucgacaccaccaaccccagauacacccccaagcugggcagcgugcugaugaacagcgagagcagcgacuucgacgacggccagcccaucagauucacccccaucggcaugggcgccgacgacuggcaccagugggagcugcccgaguacagcggccaccugacccugaacaugaaccuggcccccgccguggcccccgccuuccccggcgagagaauccuguucuucagaagcguggugcccagcgccggcggcuacggcagcggccagaucgacugccugaucccccaggagugggugcagcacuucuaccaggaggccgcccccagccagagcgccguggcccugaucagauacgugaaccccgacaccggcagaaacaucuucgaggccaagcugcacagagagggcuucaucaccguggccaacagcggcaacaaccccaucguggugccccccaacggcuacuucagauucgaggccugggugaaccaguucuacacccugacccccaugggcaccggccagggcagaagaagagugcaguga

SEQ ID NO: 22407 - RNA, 1644 nt, Artificial Sequence
  derived and/or modified sequence opt4 from capsid_protein_VP1__Norovirus__BAN16295
augaagauggccagcaacgacgccgcccccagcaacgacggcgccgccaaccuggugcccgaggccaacaacgaggugauggcccuggagcccguggugggcgccagcaucgccgcccccguggugggccagcagaacaucaucgaccccuggaucagagagaacuucgugcaggccccccagggcgaguucaccgugagccccagaaacagccccggcgagaugcugcugaaccuggagcugggccccgagcugaaccccuaccugagccaccugagcagaauguacaacggcuacgccggcggcaugcaggugcaggaggugcuggccggcaacgccuucaccgccggcaagaucaucuucgccgccgugcccccccacuuccccguggagaacaucagcgccgcccagaucaccaugugcccccacgugaucguggacgugagacagcuggagcccgugcugcugccccugcccgacaucagaaacagauucuuccacuacaaccaggaggacacccccagaaugagacugguggccaugcuguacaccccccugagagccaacagcggcgaggacguguucaccgugagcugcagagugcugaccagacccgcccccgacuucgaguucaccuuccuggugccccccaccguggagagcaagaccaagcccuucacccugcccauccugacccugggcgagcugagcaacagcagauuccccgcccccaucgacaugcuguacaccgaccccaacgagaccaucguggugcagccccagaacggcagaugcacccuggacggcacccugcagggcaccacccagcuggugcccacccagaucugcagcuucagaggcacccugaucagccagaccagcagaagcgccgacagcaccgacagcgcccccagagugagaaaccacccccugcacgugcagcugaagaaccuggacggcacccccuacgaccccaccgacgaggugcccgccgugcugggcgccaucgacuucaagggcaccguguucggcguggccagccagagaaacaccaccggcagcagcgugggcgccaccagagcccacgaggugcacaucgacaccaccaaccccagauacacccccaagcugggcagcgugcugaugcacagcgagagcagcgacuucgacgacggccagcccaccagauucacccccaucggcaugggcgccgacgacuggagacagugggagcugcccgaguacagcggccaccugacccugaacaugaaccuggcccccgccguggcccccgccuuccccggcgagagaauccuguucuucagaagcguggugcccagcgccggcggcuacggcagcggccagaucgacugccugaucccccaggagugggugcagcacuucuaccaggaggccgcccccagccagagcgccguggcccugaucagauacgugaaccccgacaccggcagaaacaucuucgaggccaagcugcacagagagggcuucaucaccguggccaacagcggcaacaaccccaucguggugccccccaacggcuacuucagauucgaggccugggugaaccaguucuacacccugacccccaugggcaccggccagggcagaagaagagugcaguga

SEQ ID NO: 22408 - RNA, 1653 nt, Artificial Sequence
  derived and/or modified sequence opt4 from capsid_protein_VP1__Norovirus__BAN16297
augaagauggccagcaacgacgccgcccccagcaacgacggcgccgccaaccuggugcccgaggccaacaacgaggugauggcccuggagcccguggugggcgccagcaucgccgcccccguggugggccagcagaacaucaucgaccccuggaucagagagaacuucgugcaggccccccagggcgaguucaccgugagccccagaaacagccccggcgagaugcugcugaaccuggagcugggccccgagcugaaccccuaccugagccaccugagcagaauguacaacggcuacgccggcggcaugcaggugcagguggugcuggccggcaacgccuucaccgccggcaagaucaucuucgccgccgugcccccccacuuccccguggacaacaucagcgccgcccagaucaccaugugcccccacgugaucguggacgugagacagcuggagcccgugcugcugccccugcccgacaucagaaacagauucuuccacuacaaccaggagaacacccccagaaugagacugguggccaugcuguacaccccccugagagccaacagcggcgaggacguguucaccgugagcugcagagugcugaccagacccgcccccgacuucgaguucaccuuccuggugccccccaccguggagagcaagaccaagcccuucacccugcccgugcugacccugggcgagcugagcaacagcagauuccccgccgccaucgacaugcuguacaccgaccccaacgagagcaucguggugcagccccagaacggcagaugcacccuggacggcacccugcagggcaccacccagcuggugcccacccagaucugcgccuucagaggcacccugaucagccagaccgccagagccgccgacagcguggacagcccccagagagccagagaccacccccugcacgugcaggugaagaaccuggacggcacccaguacgaccccaccgacgacauccccgccgugcugggcgccaucgacuucaagggcaccguguucggcguggccagccagagagacgugagcggcacccaggagcagggccacuacgccaccagagcccacgaggcccacaucgacaccaccgaccccaaguacgcccccaagcugggcaccauccugaucaagagcgacagcaacgacuucaacaccaaccagcccaucagauucacccccgugggcaugggcgacaacaacuggagacagugggagcugcccgacuacagcggcagacugacccugaacaugaaccuggcccccgccgugagccccagcuuccccggcgagagaauccuguucuucagaagcaucgugcccagcgccggcggcuacggcagcggcuacaucgacugccugaucccccaggagugggugcagcacuucuaccaggaggccgcccccagccagagcgccguggcccuggugagauacgugaaccccgacaccggcagaaacaucuucgaggccaagcugcacagagagggcuuccugaccguggccaacagcggcaacaaccccaucguggugccccccaacggcuacuucagauucgaggccugggugaaccaguucuacacccuggcccccaugggcagcggccagggcagaagaagagcccaguga

SEQ ID NO: 22409 - RNA, 1623 nt, Artificial Sequence
  derived and/or modified sequence opt4 from capsid_protein_VP1__Norovirus__BAR42289
augaagauggccagcaacgacgccgcccccagcaacgacggcgccgccggccuggugcccgagggcaacaacgagacccugccccuggagcccguggccggcgccgccaucgccgcccccgugaccggccagaacaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacagcaaccagcccaacagcagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucagccugcccauccugacccugagcgagcugaccaacagcagauuccccgugcccaucgacagccuguucaccgcccagaacaacgugcugcaggugcagugccagaacggcagaugcacccuggacggcgagcugcagggcaccacccagcugcugcccaccggcaucugcgccuucagaggcagagugaccgcccagaucaaccagagagacagauggcacaugcagcugcagaaccugaacggcaccaccuacgaccccaccgacgacgugcccgccccccugggcacccccgacuucaagggcgugguguucggcauggugagccagagaaacgugggcaacgacgcccccggcagcaccagagcccagcaggccugggugagcaccuacagcccccaguucgugcccaagcugggcagcgugaaccugagaaucagcgacaacgacgacuuccaguuccagcccaccaaguucacccccgugggcgugaacgacgacgacgacggccaccccuucagacagugggagcugcccaacuacagcggcgagcugacccugaacaugaaccuggccccccccguggcccccaacuuccccggcgagcagcugcuguucuucagaagcuucgugcccugcagcggcggcuacaaccagggcaucaucgacugccugaucccccaggaguggauccagcacuucuaccaggagagcgcccccagccagagcgacguggcccugaucagauacgugaaccccgacaccggcagaacccuguucgaggccaagcugcacagaagcggcuacaucaccguggcccacagcggcgacuacccccugguggugcccgccaacggccacuucagauucgacagcugggugaaccaguucuacagccuggcccccaugggcaccggcaacggcagaagaagagcccaguga

SEQ ID NO: 22410 - RNA, 1617 nt, Artificial Sequence
  derived and/or modified sequence opt4 from capsid_protein_VP1__Norovirus__BAR47616
augaagauggccagcaacgacgccgcccccagcaacgacggcgccgccggccuggugcccgagggcaacaacgagacccugccccuggagcccguggccggcgccgccaucgccgcccccgugaccggccagaacaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacaacaaccagcccaacagcagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucagccugcccauccugacccugagcgagcugaccaacagcagauuccccgugcccaucgacagccuguucaccgcccagaacaacgugcugcaggugcagugccagaacggcagaugcacccuggacggcgagcugcagggcaccacccagcugcugcccagcggcaucugcgccuucagaggcagagugaccgccgagaccgaccacagagacaaguggcacaugcagcugcagaaccugaacggcaccaccuacgaccccaccgacgacgugcccgccccccugggcacccccgacuucaagggcgugguguucggcguggccagccagagaaacgugggcaacgacgcccccggcagcaccagagcccacgaggccgugaucagcaccuacagcccccaguucgugcccaagcugggcagcgugaacuucagaagcaacgacaacgacuuccagcugcagcccaccaaguucacccccgugggcaucaacgacgacggcgaccaccccuucagacagugggagcugcccgacuacagcggccugcugacccugaacaugaaccuggccccccccguggcccccaacuuccccggcgagcagcugcuguucuucagaagcuucgugcccugcagcggcggcuacaaccagggcaucguggacugccugaucccccaggaguggauccagcacuucuaccaggagagcgcccccagccagagcgacguggcccugaucagauacgugaaccccgacaccggcagaacccuguucgaggccaagcugcacagaagcggcuacaucaccguggcccacagcggcgacuacccccugguggugcccgccaacggcuacuucagauucgacagcugggugaaccaguucuacagccuggcccccaugggcaccggcaacggcagaagaagagcccaguga

SEQ ID NO: 22411 - RNA, 1617 nt, Artificial Sequence; identical to SEQ ID NO: 22410
  derived and/or modified sequence opt4 from capsid_protein_VP1__Norovirus__BAR63715

SEQ ID NO: 22412 - RNA, 1617 nt, Artificial Sequence; identical to SEQ ID NO: 22410
  derived and/or modified sequence opt4 from capsid_protein_VP1__Norovirus__BAR63718

SEQ ID NO: 22413 - RNA, 1617 nt, Artificial Sequence; identical to SEQ ID NO: 22410
  derived and/or modified sequence opt4 from capsid_protein_VP1__Norovirus__BAR63721

SEQ ID NO: 22414 - RNA, 1623 nt, Artificial Sequence
  derived and/or modified sequence opt4 from capsid_protein_VP1__Norovirus__BAS02083
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaccaccggcagccacaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccaaccacgacuucgaggccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22415 - RNA, 1635 nt, Artificial Sequence
  derived and/or modified sequence opt4 from capsid_protein_VP1__Norovirus__CRL46952
augaugauggccagcaaggacgccacccccagcgccgacggcgccaccggcgccggccagcuggugcccgaggugaacaccgccgaccccauccccaucgaccccguggccggcagcagcaccgcccuggccaccgccggccaggugaaccugaucgaccccuggaucaucaacaacuucgugcaggccccccagggcgaguucaccaucagccccaacaacacccccggcgacgugcuguucgaccugcagcugggcccccaccugaaccccuuccugagccaccugagccagauguacaacggcugggugggcaacaugagagugagaguggugcuggccggcaacgccuucaccgccggcaaggugaucaucugcugcgugccccccggcuuccagagcagaacccugagcaucgcccaggccacccuguucccccacgugaucgccgacgugagaacccuggaccccguggaggugccccuggaggacgugagaaacgugcuguaccacaacaacgacacccagcccaccaugagacugcugugcaugcuguacaccccccugagaaccggcggcgccagcggcggcaccgacagcuucgugguggccggcagagugcugaccugccccggccccgacuucaacuuccuguuccuggugccccccaccguggagcagaagaccagacccuucaccgugcccaacaucccccugaaguaccugagcaacagcagaauccccaaccccaucgagggcaugagccugagccccgaccagacccagaacgugcaguuccagaacggcagaugcaccaucgacggccagccccugggcaccacccccgugagcgugagccagcugugcaaguucagaggcagaaucaccagcggccagagagugcugaaccugaccgagcuggacggcagccccuucauggccuucgccgcccccgcccccgccggcuuccccgaccugggcagcugcgacuggcacaucgagaugagcaagauccccaacagcagcacccagaacaaccccaucguggugaacagcgugaagcccaacagccagcaguucgugccccaccugagcagcaucacccuggacgacaucgugagcagcggcggcgacuacaucggcaccauccaguggaccagcccccccagcgacagcggcggcgccaacaccaacuucuggaagauccccgacuacggcagcagccugagcgaggccagccagcuggcccccgccguguacccccccggcuucaacgaggugaucguguacuucauggccagcauccccggccccaaccagagcggcagccccaaccuggugcccugccugcugccccaggaguacaucacccacuucaucagcgagcaggcccccauccagggcgaggccgcccugcugcacuacguggaccccgacaccaacagaaaccugggcgaguucaagcuguaccccggcggcuaccugaccugcgugcccaacagcagcagcaccggcccccagcagcugccccuggacggcguguucguguucgccagcugggugagcagauucuaccagcugaagcccgugggcaccgccggccccgccagaggcagacugggcgugagaagauga

SEQ ID NO: 22416 - RNA, 1623 nt, Artificial Sequence
  derived and/or modified sequence opt4 from capsid_protein_VP1__Norovirus__CRL46955
augaugauggccagcaaggacgcccccaccagccccgacggcgccagcggcgccggccagcuggugcccgaggccaacaccgccgagcagaucagcauggaccccguggccggcgccagcaccgccguggccaccgccggccaggugaacaugaucgaccccuggaucuucaacaacuucgugcaggccccccagggcgaguucaccaucagccccaacaacacccccggcgacauccuguucgaccugcagcugggcccccaccugaaccccuuccuggcccaccugagccagauguacaacggcugggugggcaacaugagagugagaauccugcuggccggcaacgccuucaccgccggcaagaucaucaucugcugcgugccccccggcuucgacgccagaauccugaccaucgcccaggccacccuguucccccaccugaucgccgacgugagaacccuggagcccguggagcugccccuggaggacgugagaaacgugcuguaccacaacagcagccagccccagcccaccaugagacugguggccaugcuguacaccccccugagaaccggcggcggcagcggcggcaccgacgccuucgugguggccggcagagugcugaccugccccgcccccgacuucagcuuccuguuccuggugccccccagcguggagcagaagaccagaguguucagcgugcccaacaucccccugaaggaccugagcaacagcagagugcccgugcccauccagggcauguucaugagccccgacgugaaccagagcgugcaguuccagaacggcagaugccagaucgacggccagcugcagggcaccacccccgugagccugagccagcugugcaagaucagaggcaagaccagcagcaacgccagagugcugaaccugagcgagguggacggcacccccuucaucccccuggagagccccgcccccgugggcuuccccgaccugggcggcugcgacuggcacgugaacuucaccuuccaggcccagaaccaggaccccagccagagcgugaccuucgccaccaacgacgccagcuucgugcccuaccugggcagcaucagcccccacaacggcggcgacuuccacgccggcgacaucaucggcagccugggcuggaucagcgcccccagcgacaacagccagcugaacguguggaccauccccaaguacggcagcagccugcccgacgugacccaccuggcccccgccguguucccccccggcuucggcgaggugauccuguacuucuacagcaccuuccccggcagcggccagcccagccagcugcaggugcccugccugcugccccaggaguucaucacccacuucugcaacgagcaggcccccaucgccggcgaggccgcccugcugcacuacguggaccccgacaccggcagaaaccugggcgaguucaagcuguaccccgacggcuucaugaccugcgugcccaacagcgugagcagcggcccccagacccugcccaucaacggcguguucguguucgugagcugggugagcagauucuaccagcugaagcccgugggcaccgccagcgccgccagaagacugggccugagaagaaucuga

SEQ ID NO: 22417 - RNA, 1623 nt, Artificial Sequence
  derived and/or modified sequence opt4 from capsid_protein_VP1__Norovirus__CRL46958
augaagauggccagcaacgacgccaaccccagcgacggcagcgccgccaaccuggugcccgaggugaacaacgaggugauggcccuggagcccguggugggcgccgccaucgccgcccccguggccggccagcagaacaucaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccauccccauccugaccguggaggagaugaccaacagcagauuccccaucccccuggagaagcuguacaccggccccagcagcgccuucguggugcagccccagaacggcagaugcaccaccgacggcgugcugcugggcaccacccagcugagccccgugaacaucugcaccuucagaggcgacgugaccaacauccagggcagccacaccuacaccaugaaccuggccagccugaacuggaacaacuacgaccccaccgaggagacccccgccccccugggcacccccgacuucgugggcaagauccagggcgugcugacccagaccaccaagggccagggcagcaccagaggccacaaggccaccguguacaccggcagcgccagcuucacccccaagcugggcagcgugcaguucagaaccgacacccagaacgacuucgugacccaccagaacaccaaguucacccccgugggcgugauccaggacggcgacaccacccacagaaacgagccccagcagugggugcugcccaacuacagcggcgugaacacccacaacgugcaccuggcccccgccguggcccccaccauccccggcgagcagcugcuguucuucagaagcagcaugcccggcugcagcggcuaccccaacauggaccuggacugccuggugccccaggagugggugcagcacuucuaccaggaggccgcccccgcccugagcgacguggcccugcugagauucgugaaccccgacaccggcagagugcuguucgagugcaagcugcacaagagcggcuacgugaccguggcccacaccggccaccacgaccuggugaucccccccaacggcuacuucagauucgacagcugggugaaccaguucuacacccuggcccccaugggcaacggcaccggcagaagaagagugcuguga

SEQ ID NO: 22418 - RNA, 1623 nt, Artificial Sequence
  derived and/or modified sequence opt4 from capsid_protein_VP1__Norovirus__CRL46961
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugagccacaucaccggcagcagaaacuacaccaugaaccuggccagccagaacuggaacaacuacgaccccaccgaggagauccccgccccccugggcacccccgacuucgugggcaagauccagggcaugcugacccagaccaccagagccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagccguguga

SEQ ID NO: 22419 - RNA, 1623 nt, Artificial Sequence
  derived and/or modified sequence opt4 from capsid_protein_VP1__Norovirus__CRL46964
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgacuucguggugcagccccagaacggcagaugcaccaccgacggcgugcugcugggcaccacccagcugagccccgugaacaucugcaccuucagaggcgacgugacccacaccaccggcagcagaaacuacaccaugaaccuggccagccagaacuggaacaacuacgaccccaccgaggagacccccgccccccugggcacccccgacuucgugggcaagaucagaggcaugcugacccagaccaccagagccgacggcagcaccagaggccacaaggccaccguguacaccggcagcgccgacuucgcccccaagcugggcagagugcaguucgagaccgacaccgacaacgacuucgacgccaaccagaacaccaaguucacccccgugggcgugauccaggacggcaccaccacccacagaaacgagcccagacagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguucuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcaccggcagaagaagagccguguga

SEQ ID NO: 22420 - RNA, 1644 nt, Artificial Sequence
  derived and/or modified sequence opt4 from capsid_protein_VP1__Norovirus__CRL46967
augaagauggccagcaacgacgccgcccccagcaacgacggcgccgccaaccuggugcccgaggccaccagcgaggugauggcccuggagcccguggugggcgccagcaucgccgcccccguggugggccagcagaacaucaucgaccccuggaucagagagaacuucgugcaggccccccagggcgaguucaccgugagccccagaaacagccccggcgagaugcugcugaaccuggagcugggccccgagcugaaccccuaccugagccaccugagcagaauguacaacggcuacgccggcggcaugcaggugcagguggugcuggccggcaacgccuucaccgccggcaagaucaucuucgccgccgugcccccccacuuccccguggagaacaucagcgccgcccagaucaccaugugcccccacgugaucguggacgugagacagcuggagcccgugcugcugccccugcccgacaucagaaacagauucuuccacuacaaccaggagaacacccccagaaugagacugguggccaugcuguacaccccccugagagccaacagcggcgaggacguguucaccgugagcugcagagugcugaccagacccgcccccgacuucgaguucaccuuccuggugccccccaccguggagagcaagaccaagcccuucacccugcccauccugacccugggcgagcugagcaacagcagauuccccgcccccaucgacaugcuguacaccgaccccaacgaggccaucguggugcagccccagaacggcagaugcacccuggacggcacccugcagggcaccacccagcuggugcccacccagaucugcagcuucagaggcacccugaucagccagaccagcagaagcgccgacagcaccgacagcgcccccagagugagaaaccacccccugcacgugcagcugaagaaccuggacggcacccccuacgaccccaccgacgaggugcccgccgugcugggcgccaucgacuucaagggcaccguguucggcguggccagccagagaaacaccaccggcagcagcaucggcgccaccagagcccacgaggugcacaucgacaccaccaaccccagauacgcccccaagcugggcagcgugcugauguacagcgagagcaccgacuucgacgacggccagcccaccagauucacccccaucggcaugggcgccgacgacuggcaccagugggagcugcccgaguacagcggccaccugacccugaacaugaaccuggcccccgccguggcccccgccuuccccggcgagagaauccuguucuucagaagcguggugcccagcgccggcggcuacggcagcggccacaucgacugccugaucccccaggagugggugcagcacuucuaccaggaggccgcccccagccagagcgccguggcccugaucagauacgugaaccccgacaccggcagaaacaucuucgaggccaagcugcacagagagggcuucaucaccguggccaacagcggcaacaaccccaucguggugccccccaacggcuacuucagauucgaggccugggugaaccaguucuacacccugacccccaugggcaccggccagggcagaagaagagugcaguga

SEQ ID NO: 22421 - RNA, 1647 nt, Artificial Sequence
  derived and/or modified sequence opt4 from capsid_protein_VP1__Norovirus__CRL46970
augaagauggccagcaacgacgccgcccccagcaacgacggcgccgccggccuggugcccgagaucaacaacgaggccauggcccuggagcccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgccuucaccgccggcaagaucaucuucgccgccaucccccccaacuuccccaucgacaaccugagcgccgcccagaucaccaugugcccccacgugaucguggacgugagacagcuggagcccgugaaccugcccaugcccgacgugagaaacaacuucuuccacuacaaccagggcagcgacagcagacugagacugaucgccaugcuguacaccccccugagagccaacaacagcggcgacgacguguucaccgugagcugcagagugcugaccagacccagccccgacuucagcuucaacuuccuggugccccccaccguggagagcaagaccaagcccuucagccugcccauccugaccaucagcgagaugagcaacagcagauuccccgugcccaucgacagccugcacaccagccccaccgagaacaucguggugcagugccagaacggcagagugacccuggacggcgagcugaugggcaccacccagcugcugcccagccagaucugcgccuucagaggcgugcugaccagaagcaccagcagagccagcgaccaggccgacaccgccacccccagacuguucaacuacuacuggcacauccagcuggacaaccugaacggcacccccuacgaccccgccgaggacauccccggcccccugggcacccccgacuucagaggcaagguguucggcguggccagccagagaaaccuggacaccaccaccagagcccacgaggccaagaucgacaccaccagcggcagauucacccccaagcugggcagccuggagaucagcaccgagagcagcgacuucgaccagagccagcccaccagauucacccccgugggcaucggcguggaccacgaggccgacuuccagcaguggacccugcccgacuacgccggccaguucacccacaacaugaaccuggcccccgccguggcccccaacuuccccggcgagcagcugcuguucuucagaagccaccugcccagcagcggcggcagaagcaacggcauccuggacugccuggugccccaggagugggugcagcacuucuaccaggagagcgcccccagccagagccagguggcccuggugagauacgugaaccccgacaccggcagagugcuguucgaggccaagcugcacaagcugggcuucaugaccaucgccaagaacggcgacagccccaucaucgugccccccaacggcuacuucagauucgagagcugggugaaccccuucuacacccuggcccccaugggcaccggcaacggcagaagaagaauccaguga

SEQ ID NO: 22422 - RNA, 1608 nt, Artificial Sequence
  derived and/or modified sequence opt4 from capsid_protein_VP1__Norovirus__CRL46973
augaagauggccagcaacgacgccgcccccagcaacgacggcgccgccggccuggugcccgaggugaacaacgagaccauggcccuggagcccguggccggcgccagcaucgccgccccccugaccggccagaacaacgugaucgaccccuggaucagaaugaacuucgugcaggcccccaacggcgaguucaccgugagccccagaaacagccccggcgaggugcugcuggagcuggagcugggccccgagcugaaccccuuccuggcccaccugagcagaauguacaacggcuacgccggcggcguggaggugcaggugcugcuggccggcaacgccuucaccgccggcaagcugguguucgccgccauccccccccacuucccccuggagaaccugagccccggccagaucaccauguucccccacgugaucaucgacgugagaacccuggagcccgugcugcugccccugcccgacgugagaaacaacuucuuccacuacaaccagcagcccgaggccagaaugaagcugguggccaugcuguacaccccccugagaagcaacggcagcggcgacgacguguucaccgugagcugcagagugcugaccagacccagccccgacuucgacuucaacuaccuggugccccccaccguggagagcaagaccaagcccuucacccugcccauccugaccaucggcgagcugagcaacagcagauuccccgugcccaucgacauccuguacaccagccccaacgagggcgugguggugcagccccagaacggcagaagcacccuggacggcgagcugcugggcaccacccagaucgugcccagcaacaucugcgcccugagaggcagaaucaacgcccacgugcccaacgagcccaaccaguggaaccugcaggugaccaacgccaacggcacccccuucgaccccaccgaggacgugcccgccccccugggcacccccgacuuccaggccaacaucuacggcgugaccggccagagaaacagcgacagcagcugcagagcccacgacggcgugcuggccaccuggagccccaaguucacccccaagcugggcagcguggugcugggcaccugggagaaggaggacuucaacaucaaccagcccaccagauucacccccaucggccugcacaacaccgagcacuucaagcagugggugcugcccaacuacagcggcaugcugacccugaacaugaaccuggcccccagcguggccccccuguuccccggcgagcagauccuguucuucagaagcuucaucccccugaacggcggcaagagcgacggcgccaucgacugccugcugccccaggaguggauccagcacuucuaccaggagagcgcccccagccccaccgacguggcccugaucagauacaccaaccccgacaccggcagagugcuguucgaggccaagcugcacagacagggcuucaucaccguggccagcagcggcagcaagcccaucguggugccccccaacggcuacuucagauucgacagcugggugaaccaguucuacagccuggcccccaugggcaccggcaacggcagaagaagagugcaguga

SEQ ID NO: 22423 - RNA, 1623 nt, Artificial Sequence
  derived and/or modified sequence opt4 from capsid_protein_VP1__Norovirus__CRL46976
augaagauggccagcaacgacgccgcccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugauccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22424 - RNA, 1623 nt, Artificial Sequence
  derived and/or modified sequence opt4 from capsid_protein_VP1__Norovirus__CRL46979
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugauccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22425 - RNA, 1623 nt, Artificial Sequence
  derived and/or modified sequence opt4 from capsid_VP1__Norovirus__ABC96332
augaagauggcccccaacgacgccagccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugagcaucugcaccuucagaggcgacgugacccacauccccggcaccagaaucuacagaaugaaccuggccagccagaacuggaacaacuacgaccccaccgaggagauccccgccccccugggcacccccgacuucgugggcaagauccagggcaugcugacccagaccaccaagggcgacggcagcaccagaggccacaaggccaccgugagcaccggcagcguggacuucacccccaagcugggcagcgugcaguucgccaccgacaccgacaacgacuucgagaccggccagaacaccagauucacccccgugggcgugauccaggacggcagcagcgcccacagaaacgagccccagcagugggugcugcccgacuacagcggcagaaccgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccagccagagcgacguggcccugcugagauucgugaaccccgacaccggcagagugcuguucgagugcaagcugcacaaggccggcuacgugaccguggcccacaccggccagcacgaccuggugaucccccccaacggcuacuucagauucgacagcugggugaaccaguucuacacccuggcccccaugggcaacggcgccggcagaagaagagcccuguga

SEQ ID NO: 22426 - RNA, 1623 nt, Artificial Sequence
  derived and/or modified sequence opt4 from major_capsid_protein_VP1__Norovirus__ADB27027
augaagauggccagcaacgacgccacccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccacccagaacuggaacagcuacgaccccaccgaggagauccccgccccccugggcacccccgacuucgugggcaagauccagggcgugcugacccagaccaccagagccgacggcagcaccagaggccacaaggccaccguguacaccggcagcgccgacuucagccccaagcugggcagaauccaguucgccaccgacaccgacaacgacuucgacgccaaccagaacaccaaguucacccccgugggcgugauccaggacggcaacaccgcccacagaaacgagccccagcagugggugcugcccagcuacagcggcagaaacagccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagaccggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22427 - RNA, 1626 nt, Artificial Sequence
  derived and/or modified sequence opt4 from major_capsid_protein_VP1__Norovirus__AEE10003
augagaaugagcgacggcgccgcccccaaggccaacggcagcgaggccagcggccaggaccuggugcccaccgccguggagcaggccgugcccauccagcccguggccggcgccgcccuggccgcccccgccgccggccagaucaaccagaucgaccccuggaucuuccagaacuucgugcagugcccccugggcgaguucagcaucagccccagaaacacccccggcgagauccuguucgaccuggcccugggccccggccugaaccccuaccuggcccaccugagcgccauguacaccggcugggugggcaacauggaggugcagcuggugcuggccggcaacgccuucaccgccggcaagguggugguggcccuggugccccccuacuuccccaagggcagccugaccaccgcccagaucaccugcuucccccacgugaugugcgacgugagaacccuggagcccauccagcugccccugcuggacgugagaagagugcuguggcacgccacccaggaccaggaggagagcaugagacuggugugcaugcuguacaccccccugagaaccaacagccccggcgacgagagcuucguggugagcggcagacugcugagcaagcccgccgccgacuucaacuucguguaccugaccccccccaucgagagaaccaucuacagaaugguggaccugcccgugauccagcccagacugugcacccacgccagauggcccgcccccguguacggccugcugguggaccccagccugcccagcaacccccaguggcagaacggcagagugagaguggacggcacccugcugggcaccacccccgugagcggcagcugggugagcugcuucgccgccgaggccgccuacgaguuccagagcggcaccggcgagguggccaccuucacccugaucgagcaggacggcagcgccuacgugcccggcgacagagccgccccccugggcuaccccgacuucagcggccagcuggagaucgaggugcagaccgagaccaccaagaccggcgacaagcugaaggugaccaccuucgagauggugcugggccccgagaccaacguggaccaggcccccuaccagggcagaguguacgccagcgugaacgccgccgccagccuggaccugguggacggcagagugagagccgugcccagaagcguguacagcuuccaggacgugauccccgaguacaacgacggccugcuggugccccuggccccccccaucggccccuuccugcccggcgaggugcugcugagauucagaaccuacaugagacagaucgacaccaccgacgccgccgccgaggccaucgacugcgcccugccccaggaguucaucagcugguucgccagcaacgccuucaccgugcagagcgaggcccugcugcugagauacagaaacacccugaccggccagcugcuguucgagugcaagcuguacagcgagggcuacaucgcccugagcuacagcggcagcggcgcccugaccuuccccaccgacggcuucuucgagguggugagcugggugcccagacuguaccagcuggccagcgugggcagccuggccaccggcagaacccugaagcaguga

SEQ ID NO: 22428 - RNA, 1626 nt, Artificial Sequence; identical to SEQ ID NO: 22427
  derived and/or modified sequence opt4 from major_capsid_protein_VP1__Norovirus__AEE10006

SEQ ID NO: 22429 - RNA, 1626 nt, Artificial Sequence; identical to SEQ ID NO: 22427
  derived and/or modified sequence opt4 from major_capsid_protein_VP1__Norovirus__AEE10009

SEQ ID NO: 22430 - RNA, 1626 nt, Artificial Sequence
  derived and/or modified sequence opt4 from major_capsid_protein_VP1__Norovirus__AEE10015
augagaaugagcgacggcgccgcccccaaggccaacggcagcgaggccagcggccaggaccuggugcccaccgccguggagcaggccgugcccauccagcccguggccggcgccgcccuggccgcccccgccgccggccagaucaaccagaucgaccccuggaucuuccagaacuucgugcagugcccccugggcgaguucagcaucagccccagaaacacccccggcgagauccuguucgaccuggcccugggccccggccugaaccccuaccuggcccaccugagcgccauguacaccggcugggugggcaacauggaggugcagcuggugcuggccggcaacgccuucaccgccggcaagguggugguggcccuggugccccccuacuuccccaagggcagccugaccaccgcccagaucaccugcuucccccacgugaugugcgacgugagaacccuggagcccauccagcugccccugcuggacgugagaagagugcuguggcacgccacccaggaccaggaggagagcaugagacuggugugcaugcuguacaccccccugagaaccaacagccccggcgacgagagcuucguggugagcggcagacugcugagcaagcccgccgccgacuucaacuucguguaccugaccccccccaucgagagaaccaucuacagaaugguggaccugcccgugauccagcccagacugugcacccacgccagauggcccgcccccguguacggccugcugguggaccccagccugcccagcaacccccaguggcagaacggcagagugagaguggacggcacccugcugggcaccacccccgugagcggcagcugggugagcugcuucgccgccgaggccgccuacgaguuccagagcggcaccggcgagguggccaccuucacccugaucgagcaggacggcagcgccuacgugcccggcgacagagccgccccccugggcuaccccgacuucagcggccagcuggagaucgaggugcagaccgagaccaccaagaccggcgacaagcugaaggugaccaccuucgagauggugcugggccccgagaccaacguggaccaggcccccuaccagggcagaguguacgccagcgugaacgccgccgccagccuggaccugguggacggcagagugagagccgugcccagaagcguguacagcuuccaggacgugauccccgaguacaacgacggccugcuggugccccuggccccccccaucggccccuuccugcccggcgaggugcugcugagauucagaaccuacaugagacagaucgacaccaccgacgccgccgccgaggccaucgacugcgcccugccccaggaguucgugagcugguucgccagcaacgccuucaccgugcagagcgaggcccugcugcugagauacagaaacacccugaccggccagcugcuguucgagugcaagcuguacagcgagggcuacaucgcccugagcuacagcggcagcggcgcccugaccuuccccaccgacggcuucuucgagguggugagcugggugcccagacuguaccagcuggccagcgugggcagccuggccaccggcagaacccugaagcaguga

SEQ ID NO: 22431 - RNA, 1626 nt, Artificial Sequence; identical to SEQ ID NO: 22427
  derived and/or modified sequence opt4 from major_capsid_protein_VP1__Norovirus__AEE10018

SEQ ID NO: 22432 - RNA, 1626 nt, Artificial Sequence; identical to SEQ ID NO: 22430
  derived and/or modified sequence opt4 from major_capsid_protein_VP1__Norovirus__AEE10021

SEQ ID NO: 22433 - RNA, 1626 nt, Artificial Sequence
  derived and/or modified sequence opt4 from major_capsid_protein_VP1__Norovirus__AEE10024
augagaaugagcgacggcgccgcccccaaggccaacggcagcgaggccagcggccaggaccuggugcccaccgccguggagcaggccgugcccauccagcccguggccggcgccgcccuggccgcccccgccgccggccagaucaaccagaucgaccccuggaucuuccagaacuucgugcagugcccccugggcgaguucagcaucagccccagaaacacccccggcgagauccuguucgaccuggcccugggccccggccugaaccccuaccuggcccaccugagcgccauguacaccggcugggugggcaacauggaggugcagcuggugcuggccggcaacgccuucaccgccggcaagguggugguggcccuggugccccccuacuuccccaagggcagccugaccaccgcccagaucaccugcuucccccacgugaugugcgacgugagaacccuggagcccauccagcugccccugcuggacgugagaagagugcuguggcacgccacccaggaccaggaggagagcaugagacuggugugcaugcuguacaccccccugagaaccaacagccccggcgacgagagcuucguggugagcggcagacugcugagcaagcccgccgccgacuucaacuucguguaccugaccccccccaucgagagaaccaucuacagaaugguggaccugcccgugauccagcccagacugugcacccacgccagauggcccgcccccguguacggccugcugguggaccccagccugcccagcaacccccaguggcagaacggcagagugcacguggacggcacccugcugggcaccacccccaucagcggcagcugggugagcugcuucgccgccgaggccgccuacgaguuccagagcggcaucggcgagguggccaccuucaaccugaucgagcaggacggcagcgccuacacccccggcgacagagccgccccccugggcuaccccgacuucagcggccagcuggagaucgaggugcagaccgagaccaccaagaccggcgacaagcugaaggugaccaccuucgagauggcccugggccccaagaccaacguggaccagacccccuaccagggcagaguguucgccagcaucaccguggccgccagccuggaccugguggacggcagagugagagccgugcccagaagcguguacggcuuccaggacaccauccccgaguacaacgacggccugcuggugccccuggccccccccaucggccccuuccugcccggcgaggugcugcugagauucagaaccuacaugagacagcuggacgccaccgacgccgccgccgaggccaucgacugcgcccugccccaggaguucgugagcugguucgccagcaacgccuucaccgugcagagcgaggcccugcugcugagauacagaaacacccugaccggccagcugcuguucgagugcaagcuguacagcgagggcuacaucgcccugagcuacagcggcagcggcccccugaccuuccccaccgacggcuucuucgagguggugagcugggugcccagacuguaccagcuggccagcgugggcagccuggccaccggcagaacccugaagcaguga

SEQ ID NO: 22434 - RNA, 1626 nt, Artificial Sequence
  derived and/or modified sequence opt4 from major_capsid_protein_VP1__Norovirus__AEE10027
augagaaugagcgacggcgccgcccccaaggccaacggcagcgaggccagcggccaggaccuggugcccaccgccguggagcaggccgugcccauccagcccguggccggcgccgcccuggccgcccccgccgccggccagaucaaccagaucgaccccuggaucuuccagaacuucgugcagugcccccugggcgaguucagcaucagccccagaaacacccccggcgagauccuguucgaccuggcccugggccccggccugaaccccuaccuggcccaccugagcgccauguacaccggcugggugggcaacauggaggugcagcuggugcuggccggcaacgccuucaccgccggcaagguggugguggcccuggugccccccuacuuccccaagggcagccugaccaccgcccagaucaccugcuucccccacgugaugugcgacgugagaacccuggagcccauccagcugccccugcuggacgugagaagagugcuguggcacgccacccaggaccaggaggagagcaugagacuggugugcaugcuguacaccccccugagaaccaacagccccggcgacgagagcuucguggugagcggcagacugcugagcaagcccgccgccgacuucaacuucguguaccugaccccccccaucgagagaaccaucuacagaaugguggaccugcccgugcugcagcccagacugugcacccacgccagauggcccgcccccguguacggccugcugguggaccccagccugcccagcaacccccaguggcagaacggcagagugcacguggacggcacccugcugggcaccacccccgugagcggcagcugggugagcugcuucgccgccgaggccgccuacgaguuccagagcggcaccggcgagguggccaccuucaccaugaucgagcaggacggcagcgccuacgugcccggcgacagagccgccccccugggcuaccccgacuacagcggccagcuggagaucgaggugcagaccgagaccaccaagaccggcgacaagcugagagugaccaccuucgagaugauccugggccccaccaccaacguggaccaggcccccuaccagggcaagguguacgccagccugagcaccagcgccagccugaaccugguggacggcagagugagagccgugcccagaagcguguacagcuuccaggacgugcugcccgaguacaacgacggccugcuggugccccuggcccccccccugggccccuuccugcccggcgaggugcugcugagauucagaaccuacaugagacagcuggacaccgccgacgccaccgcccagcccaucgacugcgcccugccccaggaguucaucagcugguucgccagcaacaacuucaccgugcagagcgacgcccugcugaucagauacagaaacacccugaccggccagcugcuguucgaggccaagcuguacagcgagggcuacaucgccgugagcuacagcggcagcggcccccugaccuuccccaccgacggcuucuucgagguggugagcugggugcccagacuguuccagcuggccagcgugggcagccuggccaccggcagaacccugaagcaguga

SEQ ID NO: 22435 - RNA, 1608 nt, Artificial Sequence
  derived and/or modified sequence opt4 from major_capsid_protein_VP1__Norovirus__AGI96385
augaagauggccagcaacgacgccgcccccagcaacgacggcgccgccggccuggugcccgaggugaacaacgagaccauggcccuggagcccguggccggcgccagcaucgccgccccccugaccggccagaacaacgugaucgaccccuggaucagaaugaacuucgugcaggcccccaacggcgaguucaccgugagccccagaaacagccccggcgaggugcugcugaaccuggagcugggccccgagcugaaccccuuccuggcccaccugagcagaauguacaacggcuacgccggcggcgccgaggugcaggugcugcuggccggcaacgccuucaccgccggcaagcugguguucgccgccauccccccccacuucccccuggagaaccugagccccggccagaucaccauguucccccacgugaucaucgacgugagaacccuggagcccgugcugcugccccugcccgacgugagaaacaacuucuuccacuacaaccagcagcccgagcccagaaugagacugguggccaugcuguacaccccccugagaagcaacggcagcggcgacgacguguucaccgugagcugcagagugcugaccagacccagccccgacuucgacuucaacuaccuggugccccccaccguggagagcaagaccaagcccuucacccugcccauccugaccaucggcgagcugagcaacagcagauuccccgugcccaucgacgagcuguacaccagccccaacgagggcgugaucgugcagccccagaacggcagaagcacccuggacggcgagcugcugggcaccacccagcuggugcccagcaacaucugcgcccugagaggcagaaucaacgcccaggugcccgacgaccaccaccaguggaaccugcaggugaccaacgccaacggcaccagcuucgaccccaccgaggacgugcccaccccccugggcacccccgacuuccuggccaacaucuacggcgugaccagccagagaaaccccgacaacaccugcagagcccacgacggcgugcuggccaccuggagccccaaguucacccccaagcugggcagcguggugcugggcaccugggaggagagcgaccuggaccugaaccagcccaccagauucacccccgugggccuguacgacaccaaccacuucgaccaguggauccugcccaacuacagcggcagacugacccugaacaugaaccuggcccccagcguggccccccuguuccccggcgagcagauccuguucuucagaagccacaucccccugaagggcggcaccagcaacggcgccaucgacugccugcugccccaggaguggauccagcacuucuaccaggagagcgcccccagccccaccgacguggcccugaucagauacaccaaccccgacaccggcagagugcuguucgaggccaagcugcacagacagggcuucaucaccguggccaacagcggcagcagacccaucguggugccccccaacggcuacuucagauucgacagcugggugaaccaguucuacagccuggcccccaugggcaccggcaacggcagaagaagagugcaguga

SEQ ID NO: 22436 - RNA, 1644 nt, Artificial Sequence
  derived and/or modified sequence opt4 from major_capsid_protein_VP1__Norovirus__AGI96397
augaagauggccagcaacgacgccgcccccagcaacgacggcgccgccaaccuggugcccgaggccaacaacgaggugauggcccuggagcccguggugggcgccagcaucgccgcccccguggugggccagcagaacaucaucgaccccuggaucagagagaacuucgugcaggccccccagggcgaguucaccgugagccccagaaacagccccggcgagaugcugcugaaccuggagcugggccccgagcugaaccccuaccugagccaccugagcagaauguacaacggcuacgccggcggcaugcaggugcagguggugcuggccggcaacgccuucaccgccggcaagaucaucuucgccgccgugcccccccacuuccccguggagaacaucaacgccgcccagaucaccaugugcccccacgugaucguggacgugagacagcuggagcccgugcugcugccccugcccgacaucagaaacagauucuuccacuacaaccaggagaacaccagcagaaugagacugguggccaugcuguacaccccccugagagccaacagcggcgaggacguguucaccgugagcugcagagugcugaccagacccgcccccgacuucgaguucaccuuccuggugccccccaccguggagagcaagaccaagcccuucagccugcccauccugacccugggcgagcugagcaacagcagauuccccgcccccaucgacaugcuguacaccgaccccaacgagggcaucguggugcagccccagaacggcagaugcacccuggacggcacccugcagggcaccacccagcuggugcccacccagaucugcgccuucagaggcacccugaucggccagaccagcagaagccccgacagcaccgacagcgcccccagaagaagagaccacccccugcacgugcagcugaagaaccuggacggcacccaguacgaccccaccgacgaggugcccgccgugcugggcgccaucgacuucaagggcaccguguucggcguggccagccagagagacgugagcggccagcaggugggcgccaccagagcccacgaggugcacaucaacaccaccgaccccagauacacccccaagcugggcagcauccugauguacagcgagagcgacgacuucgugaccggccagcccgugagauucacccccaucggcaugggcgacaacgacuggcaccagugggagcugcccgacuaccccggccaccugacccugaacaugaaccuggcccccgccguggcccccgccuuccccggcgagagaauccuguucuucagaagcaucgugcccagcgccggcggcuacggcagcggccagaucgacugccugaucccccaggagugggugcagcacuucuaccaggaggccgcccccagccagagcgccguggcccugaucagauacgugaaccccgacaccggcagaaacaucuucgaggccaagcugcacagagagggcuucaucaccguggccaacagcggcaacaaccccaucguggugccccccaacggcuacuucagauucgaggccugggugaaccaguucuacacccugacccccaugggcaccggccagggcagaagaagagaccaguga

SEQ ID NO: 22437 - RNA, 1608 nt, Artificial Sequence
  derived and/or modified sequence opt4 from major_capsid_protein_VP1__Norovirus__AGI96398
augaagauggccagcaacgacgccgcccccagcaacgacggcgccgccggccuggugcccgaggugaacaacgagaccauggcccuggagcccguggccggcgccagcaucgccgccccccugaccggccagaacaacgugaucgaccccuggaucagaaugaacuucgugcaggcccccaacggcgaguucaccgugagccccagaaacagccccggcgaggugcugcugaaccuggagcugggccccgagcugaaccccuuccuggcccaccugagcagaauguacaacggcuacgccggcggcguggaggugcaggugcugcuggccggcaacgccuucaccgccggcaagcugguguucgccgccauccccccccacuucccccuggagaaccugagccccggccagaucaccauguucccccacgugaucaucgacgugagaacccuggagcccgugcugcugccccugcccgacgugagaaacaacuucuuccacuacaaccagcagcccgagcccagaaugagacugguggccaugcuguacaccccccugagaagcaacggcagcggcgacgacguguucaccgugagcugcagagugcugaccagacccagccccgacuucgacuucaacuaccuggugccccccaccguggagagcaagaccaagcccuucacccugcccauccugaccaucggcgagcugagcaacagcagauuccccgugcccaucgacgagcuguacaccagccccaacgagggcgugaucgugcagccccagaacggcagaagcacccuggacggcgagcugcugggcaccacccagcuggugcccagcaacaucugcgcccugagaggcagaaucaacgcccaggugcccgacgaccaccaccaguggaaccugcaggugaccaacgccaacggcaccagcuucgaccccaccgaggacgugcccgccccccugggcacccccgacuuccuggccaacaucuacggcgugaccagccagagaaaccccgacaacaccugcagagcccacgacggcgugcuggccaccuggagccccaaguucacccccaagcugggcagcguggugcugggcaccugggaggagagcgaccuggaccugaaccagcccaccagauucacccccgugggccuguacgacaccaaccacuucgaccaguggauccugcccaacuacagcggcagacugacccugaacaugaaccuggcccccagcguggccccccuguuccccggcgagcagauccuguucuucagaagccacaucccccugaagggcggcaccagcaacggcgccaucgacugccugcugccccaggaguggauccagcacuucuaccaggagagcgcccccagccccaccgacguggcccugaucagauacaccaaccccgacaccggcagagugcuguucgaggccaagcugcacagacagggcuucaucaccguggccaacagcggcagcagacccaucguggugccccccaacggcuacuucagauucgacagcugggugaaccaguucuacagccuggcccccaugggcaccggcaacggcagaagaagagugcaguga

SEQ ID NO: 22438 - RNA, 1608 nt, Artificial Sequence
  derived and/or modified sequence opt4 from major_capsid_protein_VP1__Norovirus__AGI96399
augaagauggccagcaacgacgccgcccccagcaacgacgacgccgccggccuggugcccgaggugaacaacgagaccauggcccuggagcccguggccggcgccagcaucgccgccccccugaccggccagaacaacgugaucgaccccuggaucagaaugaacuucgugcaggcccccaacggcgaguucaccgugagccccagaaacagccccggcgaggugcugcugaaccuggagcugggccccgagcugaaccccuuccuggcccaccugagcagaauguacaacggcuacgccggcggcguggaggugcaggugcugcuggccggcaacgccuucaccgccggcaagcugguguucgccgccauccccccccacuucccccuggagaaccugagccccggccagaucaccauguucccccacgugaucaucgacgugagaacccuggagcccgugcugcugccccugcccgacgugagaaacaacuucuuccacuacaaccagcagcccgagcccagaaugagacugguggccaugcuguacaccccccugagaagcaacggcagcggcgacgacguguucaccgugagcugcagagugcugaccagacccagccccgacuucgacuucaacuaccuggugccccccaccguggagagcaagaccaagcccuucgcccugcccauccugaccaucggcgagcugagcaacagcagauuccccgugcccaucgacgagcuguacaccagccccaacgagggcgugaucgugcagccccagaacggcagaagcacccuggacggcgagcugcugggcaccacccagcuggugcccagcaacaucugcgcccugagaggcagaaucaacgcccaggugcccgacgaccaccaccaguggaaccugcaggugaccaacgccaacggcaccagcuucgaccccaccgaggacgugcccgccccccugggcacccccgacuuccuggccaacaucuacggcgugaccagccagagaaaccccgacaacaccugcagagcccacgacggcgugcuggccaccuggagccccaaguucacccccaagcugggcagcguggugcugggcaccugggaggagagcgaccuggaccugaaccagcccaccagauucacccccgugggccuguacgacaccaaccacuucgaccaguggauccugcccaacuacagcggcagacugacccugaacaugaaccuggcccccagcguggccccccuguuccccggcgagcagauccuguucuucagaagccacaucccccugaagggcggcaccagcaacggcgccaucgacugccugcugccccaggaguggauccagcacuucuaccaggagagcgcccccagccugaccgacguggcccugaucagauacaccaaccccgacaccggcagagugcuguucgaggccaagcugcacagacagggcuucaucaccguggccaacagcggcagcagacccaucguggugccccccaacggcuacuucagauucgacagcugggugaaccaguucuacagccuggcccccaugggcaccggcaacggcagaagaagagugcaguga

SEQ ID NO: 22439 - RNA, 1617 nt, Artificial Sequence
  derived and/or modified sequence opt4 from major_capsid_protein_VP1__Norovirus__AGJ52175
augauggccagcaaggacgcccccaccagccccgacggcgccagcggcgccggccagcuggugcccgaggccaacaccgccgagcagaucagcauggaccccguggccggcgccagcaccgccguggccaccgccggccaggugaacaugaucgaccccuggaucuucaacaacuucgugcaggccccccagggcgaguucaccaucagccccaacaacacccccggcgacauccuguucgaccugcagcugggcccccaccugaaccccuuccuggcccaccugagccagauguacaacggcugggugggcaacaugagagugagaauccugcuggccggcaacgccuucaccgccggcaagaucaucaucugcugcgugccccccggcuucgacgccagaauccugaccaucgcccaggccacccuguucccccaccugaucgccgacgugagaacccuggagcccguggagcugccccuggaggacgugagaaacgugcuguaccacaacagcagccagccccagcccaccaugagacugguggccaugcuguacaccccccugagaaccggcggcggcagcggcggcaccgacgccuucgugguggccggcagagugcugaccugccccgcccccgacuucagcuuccuguuccuggugccccccagcguggagcagaagaccagaguguucagcgugcccaacaucccccugaaggaccugagcaacagcagagugcccgugcccauccagggcauguucaugagccccgacgugaaccagagcgugcaguuccagaacggcagaugccagaucgacggccagcugcagggcaccacccccgugagccugagccagcugugcaagaucagaggcaagaccagcagcaacgccagagugcugaaccugagcgagguggacggcacccccuucaucccccuggagagccccgcccccgugggcuuccccgaccugggcggcugcgacuggcacgugaacuucagcuuccagacccaggacagagaccccagccagagcgugaccuucgccaccaacgacgccagcuucgugcccuaccugggcagcgugagcccccacaacggcgagggcuuccaggccggcgacaucaucggcagccugggcuggaucagcgcccccagcgacaacagccaguucaacgugugggccauccccaaguacggcagcagccugcagaugagccccauccugcugcugcugugcagccccagacugugggaggugauccuguacuucuacagcaccuuccccggcagcggccagcccagccagcugcaggugcccugccugcugccccaggaguucaucacccacuucugcaacgagcaggcccccaucgccggcgaggccgcccugcugcacuacguggaccccgacaccggcagaaaccugggcgaguucaagcuguaccccgacggcuucaugaccugcgugcccaacagcgugagcagcggcccccagacccugcccaucaacggcguguucguguucgugagcugggugagcagauucuaccagcugaagcccgugggcaccgccagcgccgccagaagacugggccugagaagaaucuga

SEQ ID NO: 22440 - RNA, 1641 nt, Artificial Sequence
  derived and/or modified sequence opt4 from major_capsid_protein_VP1__Norovirus__AGX01092
augaugauggccagcaaggacgccccccagagcgccgacggcgccagcggcgccggccagcuggugcccgaggugaacaccgccgacccccugcccauggagcccguggccggccccaccaccgccguggccaccgccggccaggugaacaugaucgaccccuggaucgugaacaacuucgugcagagcccccagggcgaguucaccaucagccccaacaacacccccggcgacauccuguucgaccugcagcugggcccccaccugaaccccuuccugagccaccugagccagauguacaacggcugggugggcaacaugagagugagaauccugcuggccggcaacgccuucagcgccggcaagaucaucgugugcuucgugccccccggcuucaccagcagcagccugaccaucgcccaggccacccuguucccccacgugaucgccgacgugagaacccuggagcccaucgagaugccccuggaggacgugagaaacgugcuguaccacaccaacgacaaccagcccaccaugagacuggugugcaugcuguacaccccccugagaaccggcggcggcagcggcagcagcgacagcuucgugguggccggcagagugcugaccgcccccagcagcgacuucagcuuccuguuccuggugccccccaccaucgagcagaagaccagagccuucaccgugcccaacaucccccugcagacccugagcaacagcagauuccccagccugauccagggcaugauccugagccccgacgccagccagguggugcaguuccagaacggcagaugccugaucgacggccagcugcugggcaccacccccgccaccagcggccagcuguucagagugagaggcaagaucaaccagggcgccagaacccugaaccugaccgagguggacggcaagcccuucauggccuucgacagccccgcccccgugggcuuccccgacuucggcaagugcgacuggcacaugagaaucagcaagacccccaacaacaccagcagcggcgaccccaugagaagcgugagcgugcagaccaacgugcagggcuucgugccccaccugggcagcauccaguucgacgagguguucaaccaccccaccggcgacuacaucggcaccaucgaguggaucagccagcccagcaccccccccggcaccgacaucaaccugugggagauccccgacuacggcagcagccugagccaggccgccaaccuggccccccccguguucccccccggcuucggcgaggcccugguguacuucgugagcgccuuccccggccccaacaacagaagcgcccccaacgacgugcccugccugcugccccaggaguacaucacccacuucgugagcgagcaggcccccaccaugggcgacgccgcccugcugcacuacguggaccccgacaccaacagaaaccugggcgaguucaagcuguaccccggcggcuaccugaccugcgugcccaacggcgugggcgccggcccccagcagcugccccugaacggcguguuccuguucgugagcugggugagcagauucuaccagcugaagcccgugggcaccgccagcaccgccagaggcagacugggcgugagaagaaucuga

SEQ ID NO: 22441 - RNA, 1647 nt, Artificial Sequence
  derived and/or modified sequence opt4 from major_capsid_protein_VP1__Norovirus__AGX01095
augaagauggccagcaacgacgccgcccccagcaacgacggcgccgccggccuggugcccgagaucagcagcgaggccauggcccuggagcccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgccuucaccgccggcaagaucaucuucgccgccaucccccccaacuuccccaucgacaaccugagcgccgcccagaucaccaugugcccccacgugaucguggacgugagacagcuggagcccgugaaccugcccaugcccgacgugagaaacaacuucuuccacuacaaccagggcagcgacagcagacugagacugaucgccaugcuguacaccccccugagagccaacaacagcggcgacgacguguucaccgugagcugcagagugcugaccagacccagccccgacuucagcuucaacuuccuggugccccccaccguggagagcaagaccaagcccuucagccugcccauccugaccaucagcgagaugagcaacagcagauuccccgugcccaucgacagccugcacaccagccccaccgagaacaucguggugcagugccagaacggcagagugacccuggacggcgagcugaugggcaccacccagcugcugcccagccagaucugcgccuucagaggcacccugaccagaagcaccagcagagccagcgaccaggccgacaccgccacccccagacuguucaacuacuacuggcacauccagcuggacaaccugaacggcacccccuacgaccccgccgaggacauccccgccccccugggcacccccgacuucagaggcaagguguucggcguggccagccagagaaaccccgacgccaccaccagagcccacgaggccaagaucgacaccaccagcggcagauucacccccaagcugggcagccuggagaucagcaccgagagcggcgacuucgaccagaaccagcccaccagauucacccccgugggcaucggcguggaccacgagcccgacuuccagcagugggcccugcccgacuacgccggccaguucacccacaacaugaaccuggcccccgccguggcccccaacuuccccggcgagcagcugcuguucuucagaagccagcugcccagcagcggcggcagaagcaacggcauccuggacugccuggugccccaggagugggugcagcacuucuaccaggagagcgcccccagccagacccagguggcccuggugagauacgugaaccccgacaccggcagagugcuguucgaggccaagcugcacaagcugagauucaugaccaucgccaagagcggcgacagccccaucaccgugccccccaacggcuacuucagauucgagagcugggugaaccccuucuacacccuggcccccaugggcaccggcaacggcagaagaagaauccaguga

SEQ ID NO: 22442 - RNA, 1623 nt, Artificial Sequence
  derived and/or modified sequence opt4 from major_capsid_protein_VP1__Norovirus__AGX01098
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcgcccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggugaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaacggccagcacgaccuggugaucccccccaacggcuacuucagauucgacagcugggugaaccaguucuacacccuggcccccaugggcaacggcaccggcagaagaagagcccuguga

SEQ ID NO: 22443 - RNA, 1623 nt, Artificial Sequence
  derived and/or modified sequence opt4 from major_capsid_protein_VP1__Norovirus__AKI30060
augaagauggccagcaacgacgccgcccccagcaacgacggcgccgccggccuggugcccgagggcaacaacgagacccugccccuggagcccguggccggcgccgccaucgccgcccccgugaccggccagaacaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacagcaaccagcccaacagcagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucagccugcccauccugacccugagcgagcugaccaacagcagauuccccgugcccaucgacagccuguucaccgcccagaacaacgugcugcaggugcagugccagaacggcagaugcacccuggacggcgagcugcagggcaccacccagcugcugcccagcggcaucugcgccuucagaggcagagugaccgcccagaucaaccagagagacagauggcacaugcagcugcagaaccugaacggcaccaccuacgaccccaccgacgacgugcccgccccccugggcacccccgacuucaagggcgugguguucggcauggugagccagagaaacgugggcaacgacgcccccggcagcaccagagcccagcaggccugggugagcaccuacagcccccaguucgugcccaagcugggcagcaucaaccugagaaucagcgacaacgacgacuuccaguuccagcccaccaaguucacccccgugggcgugaacgacgacgacgacggccaccccuucagacagugggagcugcccaacuacagcggcgagcugacccugaacaugaaccuggccccccccguggcccccaacuuccccggcgagcagcugcuguucuucagaagcuucgugcccugcagcggcggcuacaaccagggcaucaucgacugccugaucccccaggaguggauccagcacuucuaccaggagagcgcccccagccagagcgacguggcccugaucagauacgugaaccccgacaccggcagaacccuguucgaggccaagcugcacagaagcggcuacaucaccguggcccacagcggcgacuacccccugguggugcccgccaacggccacuucagauucgacagcugggugaaccaguucuacagccuggcccccaugggcaccggcaacggcagaagaagagcccaguga

SEQ ID NO: 22444 - RNA, 1626 nt, Artificial Sequence
  derived and/or modified sequence opt4 from major_capsid_protein_VP1__Norovirus__BAQ94514
augaagauggccagcaacgacgccgcccccagcaacgacggcgccgccagccuggugcccgaggccaucaacgagaccaugccccuggagcccguggccggcgccagcaucgccgcccccguggccggccagaccaacaucaucgaccccuggaucagaaccaacuucgugcaggcccccaacggcgaguucaccgugagccccagaaacagccccggcgagauccugcugaaccuggagcugggccccgaccugaaccccuaccugagccaccugagcagaauguacaacggcuacgccggcggcguggaggugcaggugcugcuggccggcaacgccuucaccgccggcaagauccuguucgccgccaucccccccaacuuccccguggacaugaucagccccgcccagaucaccaugcugccccaccugaucguggacgugagaacccuggagcccaucaugaucccccugcccgacgugagaaacguguucuaccacuucaacaaccagccccagcccagaaugagacugguggccaugcuguacaccccccugagaagcaacggcagcggcgacgacguguucaccgugagcugcagagugcugaccagacccacccccgacuucgaguucuucuaccuggugccccccagcguggagagcaagaccaagagcuucacccugcccauccugaccaucagcgagaugaccaacagcagauuccccauccccaucgagcagcuguacaccgcccccaacgagaccaacguggugcagugccagaacggcagaugcacccuggacggcgagcugcagggcaccacccagcugcugagcagcgccaucugcagcuacagaggcagaacccuggccaacaacgacagcugggaccagaaccugcugcagcugagcuaccccaacggcgccagcuacgaccccaccgacgaggugcccgccccccugggcacccaggacuucagcggcauccuguacggcgugcugacccaggacaacgugaccgagggcaccggcgaggccaagaacgccaagggcaucuacaucagcaccaccagcggcaaguucacccccaagaucggcagcaucggccugcacagcaucaccggcgacgugcaccacaaccagcagagcagauucacccccgugggcaucgccgugaacgagaacacccccuucaagcagugggugcugccccacuacagcggcagccuggcccugaacaccaaccuggcccccgccguggcccccaccuuccccggcgagcagcugcuguucuucagaagcagagugcccugcgugcagggccugcacggccaggacgccuucaucgacugccugcugccccaggagugggugaaccacuucuaccaggaggccgcccccagccagaccgacguggcccugaucagauucgugaaccccgacaccggcagaacccuguucgaggccaagcugcacagaagcggcuucaucaccgugagccacaccggcaacuacccccuggugaucccccccaacggccacuucagauucgacagcugggugaaccaguucuacagccuggcccccaugggcaccggcaacggcagaagaagaauccaguga

SEQ ID NO: 22445 - RNA, 1626 nt, Artificial Sequence
  derived and/or modified sequence opt4 from major_capsid_protein_VP1__Norovirus__BAQ94516
augaagauggccagcaacgacgccgcccccagcaacgacggcgccgccagccuggugcccgaggccaucaacgagaccaugccccuggagcccguggccggcgccagcaucgccgcccccguggccggccagaccaacaucaucgaccccuggaucagaaccaacuucgugcaggcccccaacggcgaguucaccgugagccccagaaacagccccggcgagauccugcugaaccuggagcugggccccgaccugaaccccuaccugagccaccugagcagaauguacaacggcuacgccggcggcguggaggugcaggugcugcuggccggcaacgccuucaccgccggcaagauccuguucgccgccaucccccccaacuuccccguggacaugaucagccccgcccagaucaccaugcugccccaccugaucguggacgugagaacccuggagcccaucaugaucccccugcccgacgugagaaacguguucuaccacuucaacaaccagccccagcccagaaugagacugguggccaugcuguacaccccccugagaagcaacggcagcggcgacgacguguucaccgugagcugcagagugcugaccagacccacccccgacuucgaguucuucuaccuggugccccccagcguggagagcaagaccaagcccuucacccugcccauccugaccaucagcgagaugaccaacagcagauuccccauccccaucgagcagcuguacaccgcccccaacgagaccaacguggugcagugccagaacggcagaugcacccuggacggcgagcugcagggcaccacccagcugcugagcagcgccaucugcagcuacagaggcagaacccuggccaacaacgacagcugggaccagaaccugcugcagcugagcuaccccaacggcgccagcuacgaccccaccgacgaggugcccgccccccugggcacccaggacuucagcggcauccuguacggcgugcugacccaggacaacgugaccgagggcaccggcgaggccaagaacgccaagggcaucuacaucagcaccaccagcggcaaguucacccccaagaucggcagcaucggccugcacagcaucaccggcgacgugcaccacaaccagcagagcagauucacccccgugggcaucgccgugaacgagaacacccccuucaagcagugggugcugccccacuacagcggcagccuggcccugaacaccaaccuggcccccgccguggcccccaccuuccccggcgagcagcugcuguucuucagaagcagagugcccugcgugcagggccugcacggccaggacgccuucaucgacugccugcugccccaggagugggugaaccacuucuaccaggaggccgcccccagccagaccgacguggcccugaucagauucgugaaccccgacaccggcagaacccuguucgaggccaagcugcacagaagcggcuucaucaccgugagccacaccggcaacuacccccuggugaucccccccaacggccacuucagauucgacagcugggugaaccaguucuacagccuggcccccaugggcaccggcaacggcagaagaagaauccaguga

SEQ ID NO: 22446 - RNA, 1629 nt, Artificial Sequence
  derived and/or modified sequence opt4 from major_capsid_protein_VP1__Norovirus__BAQ94520
augaagauggccagcaacgacgccgcccccagcaacgacggcgccgccagccuggugcccgaggccaucaacgagaccaugccccuggagcccguggccggcgccagcaucgccgcccccguggccggccagaccaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccaucccccccaacuuccccguggacaugaucagccccgcccagaucaccaugcugccccaccugaucguggacgugagaacccuggagcccaucaugaucccccugcccgacgugagaaacguguucuaccacuucaacaaccagccccagcccagaaugagacugguggccaugcuguacaccccccugagaagcaacggcagcggcgacgacguguucaccgugagcugcagagugcugaccagacccacccccgacuucgaguucaucuaccuggugccccccagcguggagagcaagaccaagcccuucacccugcccauccugaccaucagcgagcugaccaacagcagauuccccauccccaucgagcagcuguacaccgcccccaacgagaacaacguggugcagugccagaacggcagaugcacccuggacggcgagcugcagggcaccacccagcugcugagcagcgccgugugcagcuacagaggcagaaccguggccaacagcggcgacaacugggaccagaaccugcugcagcugaccuaccccagcggcgccagcuacgaccccaccgacgaggugcccgccccccugggcacccaggacuucagcggcauccuguacggcgugcugacccaggacaacgugagcgagagaaccggcgaggccaagaacgccaagggcaucuacaucagcaccaccagcggcaaguucacccccaagaucggcagcaucggccugcacagcaucaccgagaacgugcaccccaaccagcagagcagauucacccccgugggcguggcccagaacgagaacacccccuuccagcagugggugcugccccacuacgccggcgcccuggcccugaacaccaaccuggcccccgccguggcccccaccuuccccggcgagcagcugcuguucuucagaagcagagugcccugcgugcagggccugcagggccaggacgccuucaucgacugccugcugccccaggagugggugaaccacuucuaccaggaggccgcccccagccaggccgacguggcccugaucagauacgugaaccccgacaccggcagaacccuguucgaggccaagcugcacagaagcggcuucaucaccgugagccacaccggcgccuacccccugguggugccccccaacggccacuucagauucgacagcugggugaaccaguucuacagccuggcccccaugggcaccggcaacggcagaagaagagugcaguga

SEQ ID NO: 22447 - RNA, 1629 nt, Artificial Sequence
  derived and/or modified sequence opt4 from major_capsid_protein_VP1__Norovirus__BAQ94524
augaagauggccagcaacgacgccgcccccagcaacgacggcgccgccagccuggugcccgaggccaucaacgagaccaugccccuggagcccguggccggcgccagcaucgccgcccccguggccggccagaccaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccaucccccccaacuuccccguggacaugaucagccccgcccagaucaccaugcugccccaccugaucguggacgugagaacccuggagcccaucaugaucccccugcccgacgugagaaacguguucuaccacuucaacaaccagcaccagcccagaaugagacugguggccaugcuguacaccccccugagaagcaacggcagcggcgacgacguguucaccgugagcugcagagugcugaccagacccacccccgacuucgaguucaucuaccuggugccccccagcguggagagcaagaccaagcccuucacccugcccauccugaccaucagcgagcugaccaacagcagauuccccauccccaucgagcagcuguacaccgcccccaacgagaacaacguggugcagugccagaacggcagaugcacccuggacggcgagcugcagggcaccacccagcugcugagcagcgccgugugcagcuacagaggcagaaccguggccaacagcggcgacaacugggaccagaaccugcugcagcugaccuaccccagcggcgccagcuacgaccccaccgacgaggugcccgccccccugggcacccaggacuucagcggcauccuguacggcgugcugacccaggacaacgugagcgagagaaccggcgaggccaagaacgccaagggcaucuacaucagcaccaccagcggcaaguucacccccaagaucggcagcaucggccugcacagcaucaccgagaacgugcaccccaaccagcagagcagauucacccccgugggcguggcccagaacgagaacacccccuuccagcagugggugcugccccacuacgccggcgcccuggcccugaacaccaaccuggcccccgccguggcccccaccuuccccggcgagcagcugcuguucuucagaagcagagugcccugcgugcagggccugcagggccaggacgccuucaucgacugccugcugccccaggagugggugaaccacuucuaccaggaggccgcccccagccaggccgacguggcccugaucagauacgugaaccccgacaccggcagaacccuguucgaggccaagcugcacagaagcggcuucaucaccgugagccacaccggcgccuacccccugguggugccccccaacggccacuucagauucgacagcugggugaaccaguucuacagccuggcccccaugggcaccggcaacggcagaagaagagugcaguga

SEQ ID NO: 22448 - RNA, 1629 nt, Artificial Sequence
  derived and/or modified sequence opt4 from major_capsid_protein_VP1__Norovirus__BAQ94526
augaagauggccagcaacgacgccgcccccagcaacgacggcgccgccagccuggugcccgaggccaucaacgagaccaugccccuggagcccguggccggcgccagcaucgccgcccccguggccggccagaccaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccaucccccccaacuuccccguggacaugaucagccccgcccagaucaccaugcugccccaccugaucguggacgugagaacccuggagcccaucaugaucccccugcccgacgugagaaacguguucuaccacuucaacaaccagccccagcccagaaugagacugguggccaugcuguacaccccccugagaagcaacggcagcggcgacgacguguucaccgugagcugcagagugcugaccagacccacccccgacuucgaguucaucuaccuggugccccccagcguggagagcaagaccaagcccuucacccugcccauccugaccaccagcgagcugaccaacagcagauuccccauccccaucgagcagcuguacaccgcccccaacgagaacaacguggugcagugccagaacggcagaugcacccuggacggcgagcugcagggcaccacccagcugcugagcagcgccgugugcagcuacagaggcagaaccguggccaacagcggcgacaacugggaccagaaccugcugcagcugaccuaccccagcggcgccagcuacgaccccaccgacgaggugcccgccccccugggcacccaggacuucagcggcauccuguacggcgugcugacccaggacaacgugagcgagagaaccggcgaggccaagaacgccaagggcaucuacaucagcaccaccagcggcaaguucacccccaagaucggcagcaucggccugcacagcaucaccgagaacgugcaccccaaccagcagagcagauucacccccgugggcguggcccagaacgagaacacccccuuccagcagugggugcugccccacuacgccggcgcccuggcccugaacaccaaccuggcccccgccguggcccccaccuuccccggcgagcagcugcuguucuucagaagcagagugcccugcgugcagggccugcagggccaggacgccuucaucgacugccugcugccccaggagugggugaaccacuucuaccaggaggccgcccccagccaggccgacguggcccugaucagauacgugaaccccgacaccggcagaacccuguucgaggccaagcugcacagaagcggcuucaucaccgugagccacaccggcgccuacccccugguggugccccccaacggcuacuucagauucgacagcugggugaaccaguucuacagccuggcccccaugggcaccggcaacggcagaagaagagugcaguga

SEQ ID NO: 22449 - RNA, 1587 nt, Artificial Sequence
  derived and/or modified sequence opt4 from VP1_capsid_protein__Norovirus__ACV89840
augaugauggccagcagcgacgccaccccccccagcgagggcgccaccaaccuggugcccgaggugaacacccagguggugccccuggagcccguggccggcgccgccgccgccgcccccuucaccggccagaacaacgugaucgaccccuggaucuuccagaacuucgugcaggccccccagggcgaguucaccgugagccccagaaacacccccggcgagauccugcugagaaucccccugggccccaaccugaaccccuuccuggcccaccugagcagaauguacaacgccugggugggcggcauggaggccgagaugauccuggccggcaacgccuucaccgccggcaagcugcugaucguggcccugccccccggcuucgaggccacccagcugacccccgcccaggccaccgccuucccccacgugaucgccgacgugagaacccuggagcccauccccaucccccugcccgacaucagaaacgugcuguuccacuacaacggcgaccccacccccaccauccagaucguggugaugcuguacaccccccugagaaccaacggcaacggcgacgacguguucaccgugagcggcagacugcugaccagacccgcccccgacuucagcuucagcuuccuggugccccccaccguggagcagaagaccagaagcuucacccugcccaaccuggccgugagcgaccugagcaacagcagauuccccgcccccgugaacauccugagagccgaccccaacaccacccuggcccuggacuaccagaacggcagaugcacccuggacggcgcccugcagggcaccacccccaccaacagcagcuuccugggcuaccugagaggcaccguggacagagugaacagcgaccaggugcacgugcaccugagagagcccaacggcgaccccuuccagcugggccugcccggcccccagggcgugcccgacuacagagccacccuggacaucuacguggacugggagaacaagaaccacggcaaccccugcgagggcacccugaacaccggcagccagaccgaguacacccccggccugggcacccugaccuucaacaagaccagcggcgacacccccgagcagggcgaccccgugaucaugagacugguggccuucagaagcaaccugaccgaccagcugcccgccuacaacggcgccuucggccagggcgagaaccuggccccccccgugagcccccccgugcccggcgagguguuccugcaguucggcagcagauacaccagacugggcgagagagagcuggccgugcagugccugcugcccagcgaguggaucacccacuucuacagcgaggccgcccccauccagggcgaggccaugcugcugagauacgugcagcccgaccugggcagaauccuguucgaggccaagcuguacaaggagggcuucgugaccguggccggcggcaccaaccccgugaccuuccccaucgacggcaccuucguggccgugagcugggugagcagaaacuucgugcugagccccaugggcagcggccagggcagaagaagagccgcccuggccgaguga

SEQ ID NO: 22450 - RNA, 1587 nt, Artificial Sequence
  derived and/or modified sequence opt4 from VP1_capsid_protein__Norovirus__ACV89843
augaugauggccagcagcgacgccaccccccccagcgagggcgccaccaaccuggugcccgaggugaacacccagguggugccccuggagcccguggccggcgccgccgccgccgcccccuucaccggccagaacaacgugaucgaccccuggaucuuccagaacuucgugcaggccccccagggcgaguucaccgugagccccagaaacacccccggcgagauccugcugagaaucccccugggccccaaccugaaccccuuccuggcccaccugagcagaauguacaacgccugggugggcggcauggaggccgagaugauccuggccggcaacgccuucaccgccggcaagcugcugaucguggcccugccccccggcuucgaggccacccagcugacccccgcccaggccaccgccuucccccacgugaucgccgacgugagaacccuggagcccauccccaucccccugcccgacaucagaaacgugcuguuccacuacaacggcgaccccacccccaccauccagaucguggugaugcuguacaccccccugagaaccaacggcaacggcgacgacguguucaccgugagcggcagacugcugaccagacccgcccccgacuucagcuucagcuuccuggugccccccaccguggagcagaagaccagacccuucacccugcccaaccuggccgugagcgaccugagcaacagcagauuccccgcccccgugaacauccugagagccgaccccaacaccacccuggcccuggacuaccagaacggcagaugcacccuggacggcgcccugcagggcaccacccccaccaacagcagcuuccugggcuaccugagaggcaccguggacagagugaacagcgaccaggugcacgugcaccugagagagcccaacggcgaccccuuccagcugggccugcccggcccccagggcgugcccgacuacagagccacccuggacaucuacguggacugggagaacaagaaccacggcaaccccugcgagggcacccugaacaccggcagccagaccgaguacacccccggccugggcacccugaccuucaacaagaccagcggcgacacccccgagcagggcgaccccgugaucaugagacugguggccuucagaagcaaccugaccgaccagcugcccgccuacaacggcgccuucggccagggcgagaaccuggccccccccgugagcccccccgugcccggcgagguguuccugcaguucggcagcagauacaccagacugggcgagagagagcuggccgugcagugccugcugcccagcgaguggaucacccacuucuacagcgaggccgcccccauccagggcgaggccaugcugcugagauacgugcagcccgaccugggcagaauccuguucgaggccaagcuguacaaggagggcuucgugaccguggccggcggcaccaaccccgugaccuuccccaucgacggcaccuucguggccgugagcugggugagcagaaacuucgugcugagccccaugggcagcggccagggcagaagaagagccgcccuggccgaguga

SEQ ID NO: 22451 - RNA, 1767 nt, Artificial Sequence
  derived and/or modified sequence opt4 from VP1_capsid_protein__Norovirus__AFV48046
augagacugcagugggaggccuggagaagcaccuuccccggcaugcagccccccugcgugggcugcggccugggccccagccugcugagacccagaagaaucgugcagcccuaccugcugaugagaaugagcgacgccgugcacagaggcaacgccgccgacacccagggcgccagcgccggcgagggcagcaaccuggugcccagcaccguggaccaggccauccccauccagcccguggccggcgccgccaucgccgcccccaccgccggccaggugaaccagaucgaccccuggaucagagagaacuucgugcagugcccccugggcgaguucaccgugagccccagaaacacccccggcgaggugcuguucaaccuggcccugggccccggccugaaccccuaccugagccaccuggccgccauguacaccggcugggugggcaacauggaggugcagcuggugcuggccggcaacgccuucaccgccggcaagguggugguggcccugaucccccccuacuucaacaugcagacccugaccaccagccagaucaccugcuucccccacaucaugugcgacgugagaacccuggagcccauccugcugccccugcuggacgugagaagaacccuguggcaccccaccaacagcgaggacgacaccaugagacuggugugcaugcuguacaccccccugagaaccaacagccccggcgacgagagcuucguggugagcggcagacugcugagcagacccagccuggacuucaacuuccuguaccugaccccccccaucgcccagacccccuacgagcugcccaccgugcccagaauggugcccagcgagaugacccacagcagauggcccgcccccaucuaccaggugguggccgaccccagccugguggccaacccccaguggcagaacggcagagugaccaucgacggccagcugcugggcaccacccccaucagcagcaccugggugugcagcaucgccggcaccgccgacuacagauacaucgccggcaccgacagcuucgaggagugcaagcuggcccugagccagcccaacggcagccccuucguggugggcgacgcccccgcccccuacggcuaccccgacuucaacgccaccaucagcuucagcuuccagguggagaccagacagaacagcgccuacagcgugagagaguucagccugaccaccagcagccagaccaucaaccagagccccuacaccggcaccguguacauggacagaagcgagacccaggacuaccaguaccaggacgacagaaucagaggcgugccccacagcgugcagagcuucaaggaccagcugcccgacuacguggagagcggccagccccccaaccuggccccccccaucggccccuucaugcccggcgaggugcuggugagauucagaaccuacgugagacaggaggccaccgccgcccuguaccaggaccagcccaucgacugcgcccugccccaggaguucgugacccaccuggccacccacggcuacacccugggcagcgacgcccugcugcugagauacagaaaccugagaaccggccagcugaucugcgaggccaagcuguacgccgagggcuuccuggccaucagcuacagcggcaccggcccccugcagcugcccaccgacggcguguucgagguggugagcugggugcagagacuguaccagcuggcccccgugggcaccagcaccgccggcagaagccugggcagcuga

SEQ ID NO: 22452 - RNA, 1767 nt, Artificial Sequence
  derived and/or modified sequence opt4 from VP1_capsid_protein__Norovirus__AFV48048
augagacugcagugggaggccuggagaagcaccuuccccggcaugcagccccccugcgugggcugcggccugggccccagccugcugagacccagaagaaucgugcagcccuaccugcugaugagaaugagcgacgccgugcacagaggcaacgccgccgacacccagggcgccagcgccggcgagggcagcaaccuggugcccagcaccguggaccaggccauccccauccagcccguggccggcgccgccaucgccgcccccaccgccggccaggugaaccagaucgaccccuggaucagagagaacuucgugcagugcccccugggcgaguucaccgugagccccagaaacacccccggcgaggugcuguucaaccuggcccugggccccggccugaaccccuaccugagccaccuggccgccauguacaccggcugggugggcaacauggaggugcagcugauccuggccggcaacgccuucaccgccggcaagguggugguggcccugaucccccccuacuucaacaugcagacccugaccaccagccagaucaccugcuucccccacaucaugugcgacgugagaacccuggagcccauccugcugccccugcuggacgugagaagaacccuguggcaccccaccaacagcgaggacgacaccaugagacuggugugcaugcuguacaccccccugagaaccaacagccccggcgacgagagcuucguggugagcggcagacugcugagcagacccagccuggacuucaacuuccuguaccugaccccccccaucgcccagacccccuacgagcugcccaccgugcccagaaugauccccagcgagaugacccacagcagauggcccgcccccaucuaccaggugguggccgaccccagccugcuggccaacccccaguggcagaacggcagagugaccaucgacggccagcugcugggcaccacccccaucagcagcaccugggugugcagcaucgccggcaccgccgacuacagauacaucagcggcagcgacagcuucgaggagugcaagcuggcccugagccagcccaacggcagccccuucguggugggcgacgcccccgcccccuacggcuaccccgacuucagcgccaccaucagcuucagcuuccagguggagaccagacagaacagcgccuacagcgugagagaguucagccugaccaccagcagccagaccaucaaccagagccccuacaccggcaccguguacauggacagaagcgagacccuggacuaccaguaccaggacgacagaaucagaggcgugccccacagcgugcacgccuucagagaccagcugcccgacuacguggagagcggccagccccccaaccuggccccccccaucggccccuucaugcccggcgaggugcugcugagauucagaaccuacgugagacaggaggccaccgccgcccuguaccaggaccagcccaucgacugcgcccugccccaggaguucgugacccaccuggccacccacggcuacacccugggcagcgacgcccugcugcugagauacagaaaccugagaaccggccagcugaucugcgaggccaagcuguacgccgagggcuuccuggccaucagcuacagcggcaccggcccccugcagcugcccaucgacggcguguucgagguggugagcugggugcagagacuguaccagcuggcccccgugggcaccagcaccgccggcagaagccuggccagcuga

SEQ ID NO: 22453 - RNA, 1623 nt, Artificial Sequence
  derived and/or modified sequence opt4 from VP1_capsid_protein__Norovirus__AGH06682
augaugauggccagcaaggacgcccccaccagccccgacggcgccagcggcgccggccagcuggugcccgaggccaacaccgccgagcagaucagcauggaccccguggccggcgccagcaccgccguggccaccgccggccaggugaacaugaucgaccccuggaucuucaacaacuucgugcaggccccccagggcgaguucaccaucagccccaacaacacccccggcgacauccuguucgaccugcagcugggcccccaccugaaccccuuccuggcccaccugagccagauguacaacggcugggugggcaacaugagagugagaauccugcuggccggcaacgccuucaccgccggcaagaucaucaucugcugcgugccccccggcuucgacgccagaauccugaccaucgcccaggccacccuguucccccaccugaucgccgacgugagaacccuggagcccguggagcugccccuggaggacgugagaaacgugcuguuccacaacagcagccagccccagcccaccaugagacugguggccaugcuguacaccccccugagaaccggcggcggcagcggcggcaccgacgccuucgugguggccggcagagugcugaccugccccgcccccgacuucagcuuccuguuccuggugccccccagcguggagcagaagaccagaguguucagcgugcccaacaucccccugaaggaccugagcaacagcagagugcccgugcccgugcagggcauguucaugagccccgacgugaaccagagcgugcaguuccagaacggcagaugccagaucgacggccagcugcagggcaccacccccgugagccugagccagcugugcaagaucagaggcaagaccagcagcaacgccagagugcugaaccugagcgagguggacggcacccccuucaucccccuggagagccccgcccccgugggcuuccccgaccugggcggcugcgacuggcacgugaacuucaccuuccaggcccagaaccaggaccccagccagagcgugaccuucgccaccaacgacgccagcuucgugcccuaccugggcagcaucagcccccacaacggcggcgacuuccacgccggcgacaucaucggcagccugggcuggaucagcgcccccagcgacaacagccagcugaacguguggaccauccccaaguacggcagcagccugcccgacgugacccaccuggcccccgccguguucccccccggcuucggcgaggugauccuguacuucuacagcaccuuccccggcagcggccagagcagccagcugcaggugcccugccugcugccccaggaguucaucacccacuucugcaacgagcaggcccccaucgccggcgaggccgcccugcugcacuacguggaccccgacaccggcagaaaccugggcgaguucaagcuguaccccgacggcuucaugaccugcgugcccaacagcgugagcagcggcccccagacccugcccaucaacggcguguucguguucgugagcugggugagcagauucuaccagcugaagcccgugggcaccgccagcgccgccagaagacugggccugagaagaaucuga

SEQ ID NO: 22454 - RNA, 1620 nt, Artificial Sequence
  derived and/or modified sequence opt4 from VP1_capsid_protein__Norovirus__AGL98413
augaagauggccagcagcgacgccaaccccagcgacggcagcgccgccaaccuggugcccgaggugaacaacgaggugauggcccuggagcccguggugggcgccgccaucgccgcccccguggccggccagcagaacaucaucgaccccuggaucagaaacaacuucgugcaggcccccggcggcgaguucaccgugagccccagaaacgcccccggcgagauccuguggagcgccccccugggccccgaccugaaccccuaccugagccaccugagcagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccaggcccacgacagcacccugaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaacuucagaggcgacgugaccagagugggcaccagccacgacuacaccaugaaccuggugagccagaacuggaacaacuacgaccccaccgaggagauccccgccccccugggcacccccgacuucgugggcaagauccagggccugcugacccagaccaccagagccgacggcagcaccagagcccacaaggccaccgugagcaccggcagcgugcacuucacccccaagcugggcagcgugcaguucaccaccgacaccgacaacgacuuccagaccggccagaacaccaaguucacccccgugggcgugauccaggacggcgaccaccaccagaacgagccccagcagugggugcugcccaacuacagcggcaccagcggccacaacgugcaccuggcccccgccguggcccccgccuuccccggcgagcagcugcuguucuucagaagcaccaugcccggcugcagcggcuaccccaacaugaaccuggacugccugcugccccaggagugggugcugcacuucuaccaggaggccgcccccgcccagagcgacguggcccugcugagauucgugaaccccgacaccggcagagugcuguucgagugcaagcugcacaagagcggcuacaucaccguggcccacaccggccccuacgaccuggugaucccccccaacggcuacuucagauucgacagcugggugaaccaguucuacacccuggcccccaugggcaacggcaccggcagaagaagagcccuguga

SEQ ID NO: 22455 - RNA, 1620 nt, Artificial Sequence
  derived and/or modified sequence opt4 from VP1_capsid_protein__Norovirus__AGL98414
augaagauggccagcagcgacgccaaccccagcgacggcagcagcgccaaccuggugcccgaggugaacaacgaggugauggcccuggagcccguggugggcgccgccaucgccgcccccguggccggccagcagaacaucaucgaccccuggaucagaaacaacuucgugcaggcccccggcggcgaguucaccgugagccccagaaacgcccccggcgagauccuguggagcgccccccugagccccgaccugaaccccuaccugagccaccugagcagaauguacaacggcuacgccggcggcuucgaggugcaggugauccuggccggcaacgccuucaccgccggcaagaucguguucgccgccgugccccccaacuuccccaccgagggccugagccccagccaggugaccauguucccccacaucaucguggacgugagacagcuggagcccgugcugaucccccugcccgacgugagaaacaacuucuaccacuacaaccaggccaacgacagcacccugaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccgugcugaccguggaggagaugaccaacagcagauuccccaucccccuggagagacuguucaccggccccagcaccgccuucguggugcagccccagaacggcagaugcaccaccgacggcgugcugcugggcaccacccagcugagcgccgugaacaucugcaacuucagaggcgaggugaaccacaucgccggcacccacgacuacaccaugagacugaccagccagaacuggaacaacuacgaccccaccgaggagauccccgccccccugggcacccccgacuucgugggcagaauccagggcgugcugacccagaccaccagaagcgacggcagcaccagaagccacaaggccaccgugagcaccggcagcgugcacuucacccccaagcugggcagcgugcaguucaccaccgacaccaccaacgaccugaacgccggccagaacaccaaguucacccccgugggcguggagcagaccagcggcgaccaccagagcgagccccagcaguggacccugcccaacuacagcggcacccccaaccacaacgugcaccuggcccccgccguggcccccaccuuccccggcgagcagcugcuguucuucagaagcacccugcccggcugcggcggcuaccccaacaugaaccuggacugccugcugccccaggagugggugcugcacuucuaccaggaggccgcccccgcccagagcgacguggcccugcugagauucgugaaccccgacaccggcagagugcuguucgagugcaagcugcacagaagcggcuucaucaccguggcccacagcggcagccacgaccuggugaucccccccaacggcuacuucagauucgacagcugggugaaccaguucuacacccuggcccccaugggcaacggcagcggcagaagaagagugguguga

SEQ ID NO: 22456 - RNA, 1617 nt, Artificial Sequence
  derived and/or modified sequence opt4 from VP1_capsid_protein__Norovirus__AGL98416
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcaugccccugagccccgagcugaaccccuaccugagccaccugagcagaauguacaacggcuacgccggcggcuucgaggugcaggugauccuggccggcaacgccuucaccgccggcaagaucaucuucgccgccaucccccccaacuuccccaccgacggccugagccccagccaggugaccauguucccccacaucaucguggacgugagacagcuggagcccgugcugaucccccugcccgacgugagaaacaacuucuaccacuacaaccaggccaacgacagcacccugaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggacgagaugaccaacagcagauuccccaccccccuggagaagcugcacaccggccccaacaacagcaucguggugcagccccagaacggcagaugcaccaucgacggcgugcugcugggcaccacccagcugagcaccgugaacaucugcaacuucagaggcagcaccaccagagccggccagagccacgccuacaccaugaaccuggugagccagaacuggaacaacuacgaccccaccgaggagauccccgccccccugggcacccccgacuucgugggcaagaucgugggcaugcugagccagaccaccagagagaacagcagcaccagagcccacaaggccaccgugagcaccggcgacgcccacuucacccccaagagcggcagcgugcuguucaccaccgacaccgacgaccugcagaacggccagaacaccagauucacccccgugggcguggcccaggacggcgagccccaccagaacgagccccagcaguggagacugcccaacuacagcggcacccccggccacaacgugcaccuggccccccccguggcccccaccuuccccggcgagcagcugcuguucuucagaagcaccaugcccggcugcggcggcuaccccaacauggaccuggacugccugcugccccaggagugggugagacacuucuaccaggaggccgcccccgcccagagcgacguggcccugcugagauucgugaaccccgacaccggcagagugcuguucgagugcaagcugcacaaggccggcuacaucaccgugagccacaccggccccuacgaccuggugaucccccccaacggcuacuucagauucgacagcugggugaaccaguucuacgcccuggcccccaugggcaccggcaccggcagaagaagagcccuguga

SEQ ID NO: 22457 - RNA, 1629 nt, Artificial Sequence
  derived and/or modified sequence opt4 from VP1,_capsid_protein__Norovirus__BAL60749
augaagauggccagcaacgacgccgcccccagcaccgacggcgccgccggccuggugcccgagagcaacaacgaggugauggcccuggagcccguggccggcgccgcccuggccgcccccgugaccggccagaccaacaucaucgaccccuggaucagagccaacuucgugcaggcccccaacggcgaguucaccgugagccccagaaacgcccccggcgaggugcugcugagccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccguggagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauuccccgugagcaucgaccagauguacaccagccccaacgaggugaucagcgugcagugccagaacggcagaugcacccuggacggcgagcugcagggcaccacccagcugcaggugagcggcaucugcgccuucaagggcgaggugaccgcccaccugcacgacaacgaccaccuguacaacgugaccaucaccaaccugaacggcagccccuucgaccccagcgaggacgugcccgccccccugggcgugcccgacuuccagggcagaguguucggcgugaucagccagagagacaagcagaacgccgccggccacaacgagcccgccaacagaggccacgacgccguggugcccaccuacaccgcccaguacacccccaagcugggccaggugcagaucggcaccuggcagaccgacgaccugcaggugaaccagcccgugaaguucacccccgugggccugaacgacaccgagcacuucaaccaguggguggugcccagauacgccggcgcccugaaccugaacaccaaccuggcccccagcguggcccccguguuccccggcgagagacugcuguucuucagaagcuacaucccccugaagggcggcuacggcaaccccgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagagugcaguga

SEQ ID NO: 22458 - RNA, 1629 nt, Artificial Sequence
  derived and/or modified sequence opt4 from VP1,_capsid_protein__Norovirus__BAL60753
augaagauggccagcaacgacgccgcccccagcaccgacggcgccgccggccuggugcccgagagcaacaacgaggugauggcccuggagcccguggccggcgccgcccuggccgcccccgugaccggccagaccaacaucaucgaccccuggaucagagccaacuucgugcaggcccccaacggcgaguucaccgugagccccagaaacgcccccggcgaggugcugcugaaccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccguggagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauuccccgugagcaucgaccagauguacaccagccccaacgaggugaucagcgugcagugccagaacggcagaugcacccuggacggcgagcugcagggcaccacccagcugcaggugagcggcaucugcgccuucaagggcgaggugaccgcccaccugcacgacaacgaccaccuguacaacgugaccaucaccaaccugaacggcagccccuucgaccccagcgaggacauccccgccccccugggcgugcccgacuuccagggcagaguguucggcgugaucagccagagagacaagcacaacagccccggccacaacgagcccgccaacagaggccacgacgccguggugcccaccuacaccagccaguacacccccaagcugggccagauccagaucggcaccuggcagaccgacgaccugaccgugaaccagcccgugaaguucacccccgugggccugaacgacaccgagcacuucaaccaguggguggugcccagauacgccggcgcccugaaccugaacaccaaccuggcccccagcguggcccccguguuccccggcgagagacugcuguucuucagaagcuacaucccccugaagggcggcuacggcaaccccgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagagugcaguga

SEQ ID NO: 22459 - RNA, 1629 nt, Artificial Sequence; identical to SEQ ID NO: 22458
  derived and/or modified sequence opt4 from VP1,_capsid_protein__Norovirus__BAL60755

SEQ ID NO: 22460 - RNA, 1629 nt, Artificial Sequence
  derived and/or modified sequence opt4 from VP1,_capsid_protein__Norovirus__BAL60759
augaagauggccagcaacgacgccgcccccagcaccgacggcgccgccggccuggugcccgagagcaacaacgaggugauggcccuggagcccguggccggcgccgcccuggccgcccccgugaccggccagaccaacaucaucgaccccuggaucagagccaacuucgugcaggcccccaacggcgaguucaccgugagccccagaaacgcccccggcgaggugcugcugagccuggagcugggccccgagcugaaccccuaccuggcccaccuggccagaauguacaacggccacgccggcggcauggaggugcaggugaugcuggccggcaacgccuucaccgccggcaagcugguguucgccgccgugcccccccacuuccccguggagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauuccccgugagcaucgaccagauguacaccagccccaacgaggugaucagcgugcagugccagaacggcagaugcacccuggacggcgagcugcagggcaccacccagcugcaggugagcggcaucugcgccuucaagggcgaggugaccgcccaccugcacgacaacgaccaccuguacaacgugaccaucaccaaccugaacggcagccccuucgaccccagcgaggacgugcccgccccccugggcgugcccgacuuccagggcagaguguucggcgugaucagccagagagacaagcagaacgccgccggccacaacgagcccgccaacagaggccacgacgccguggugcccaccuacaccgcccaguacacccccaagcugggccaggugcagaucggcaccuggcagaccgacgaccugcaggugaaccagcccgugaaguucacccccgugggccugaacgacaccgagcacuucaaccaguggguggugcccagauacgccggcgcccugaaccugaacaccaaccuggcccccagcguggcccccguguuccccggcgagagacugcuguucuucagaagcuacaucccccugaagggcggcuacggcaaccccgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagagugcaguga

SEQ ID NO: 22461 - RNA, 1629 nt, Artificial Sequence
  derived and/or modified sequence opt4 from VP1,_capsid_protein__Norovirus__BAL60767
augaagauggccagcaacgacgccgcccccagcaccgacggcgccgccggccuggugcccgagagcaacaacgaggugauggcccuggagcccguggccggcgccgcccuggccgcccccgugaccggccagaccaacaucaucgaccccuggaucagagccaacuucgugcaggcccccaacggcgaguucaccgugagccccagaaacgcccccggcgaggugcugcugaaccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccaucgagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauuccccgugagcaucgaccagauguacaccagccccaacgaggugaucagcgugcagugccagaacggcagaugcacccuggacggcgagcugcagggcaccacccagcugcaggugagcggcaucugcgccuucaagggcgaggugaccgcccaccugcacgacaacgaccaccuguacaacaucaccaucaccaaccugaacggcagccccuucgaccccagcgaggacauccccgccccccugggcaugcccgacuuccagggcagaguguucggcaucaucagccagagagacagacacaacagccccggccacaacgagcccgccaacagaggccacgacgccguggugcccaccuacaccgcccaguacacccccaagcugggccagauccagaucggcaccuggcagaccgacgaccugaccgugagccagcccgugaaguucacccccgugggccugaacgacaccgagcacuucaaccaguggguggugcccagauacgccggcgcccugaaccugaacaccaaccuggcccccagcguggcccccguguuccccggcgagagacugcuguucuucagaagcuacaucccccugaagggcggcuacggcaaccccgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagagugcaguga

SEQ ID NO: 22462 - RNA, 1629 nt, Artificial Sequence
  derived and/or modified sequence opt4 from VP1,_capsid_protein__Norovirus__BAL60769
augaagauggccagcaacgacgccgugcccagcaccgacggcgccgccggccuggugcccgagagcaacaacgaggugauggcccuggagcccguggccggcgccgcccuggccgcccccgugaccggccagaccaacaucaucgaccccuggaucagagccaacuucgugcaggcccccaacggcgaguucaccgugagccccagaaacagccccggcgaggugcugcugaaccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccguggagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauuccccgugagcaucgaccagauguacaccagccccaacgaggugaucagcgugcagugccagaacggcagaugcacccuggacggcgagcugcagggcaccacccagcugcaggugagcggcaucugcgccuucaagggcgaggugaccgcccaccugcacgacaacgagcaccuguacaacgugaccaucaccaaccugaacggcagccccuucgaccccagcgaggacauccccgccccccugggcgugcccgacuuccagggcagaguguucggcgugaucagccagagagacaagcacaacacccccggccacaacgagcccgccaacagagcccacgacgccguggugcccaccuacaccgcccaguacacccccaagcugggccaggugcagaucggcaccuggcagaccgacgaccugaccgacaaccagcccgugaaguucacccccgugggccugaacgacaccgagcacuucaaccaguggguggugcccagauacgccggcgcccugaaccugaacaccaaccuggcccccagcguggcccccguguuccccggcgagagacugcuguucuucagaagcuacaucccccugaagggcggcuacggcacccccgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagaauccaguga

SEQ ID NO: 22463 - RNA, 1629 nt, Artificial Sequence
  derived and/or modified sequence opt4 from VP1,_capsid_protein__Norovirus__BAL60771
augaagauggccagcaacgacgccgcccccagcaccgacggcgccgccggccuggugcccgagagcaacaacgaggugauggcccuggagcccguggccggcgccgcccuggccgcccccgugaccggccagaccaacaucaucgaccccuggaucagagccaacuucgugcaggcccccaacggcgaguucaccgugagccccagaaacgcccccggcgaggugcugcugaaccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccguggagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauuccccgugagcaucgaccagauguacaccagccccaacgaggugaucagcgugcagugccagaacggcagaugcacccuggacggcgagcugcagggcaccacccagcugcaggugagcggcaucugcgccuucaagggcgaggugaccgcccaccugcacgacaacgaccaccuguacaacaucaccaucaccaaccugaacggcagccccuucgaccccagcgaggacauccccgccccccugggcgugcccgacuuccagggcagaguguucggcaucaucagccagagagacaagcacaacagccccggccacaacgagcccgccaacagaggccacgacgccguggugcccaccuacaccgcccaguacacccccaagcugggccagauccagaucggcaccuggcagaccgacgaccugaccgugagccagcccgugaaguucacccccgugggccugaacgacaccgagcacuucaaccaguggguggugcccagauacgccggcgcccugaaccugaacaccaaccuggcccccagcguggcccccguguuccccggcgagagacugcuguucuucagaagcuacaucccccugaagggcggcuacggcaaccccgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagagugcaguga

SEQ ID NO: 22464 - RNA, 1629 nt, Artificial Sequence
  derived and/or modified sequence opt4 from VP1,_capsid_protein__Norovirus__BAL60773
augaagauggccagcaacgacgccgcccccagcaccgacggcgccgccggccuggugcccgagagcaacaacgaggugauggcccuggagcccguggccggcgccgcccuggccgcccccgugaccggccagaccaacaucaucgaccccuggaucagagccaacuucgugcaggcccccaacggcgaguucaccgugagccccagaaacgcccccggcgaggugcugcugaaccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccguggagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauuccccgugagcaucgaccagauguacaccagccccaacgaggugaucagcgugcagugccagaacggcagaugcacccuggacggcgagcugcagggcaccacccagcugcaggugagcggcaucugcgccuucaagggcgaggugaccgcccaccugcacgacaacgaccaccuguacaacgugaccaucaccaaccugaacggcagccccuucgaccccagcgaggacauccccgccccccugggcgugcccgacuuccagggcagaguguucggcaucaucagccagagagacaagcacaacagccccggccacaacgagcccgccaacagaggccacgacgccguggugcccaccuacaccgcccaguacacccccaagcugggccagauccagaucggcaccuggcagaccgacgaccugaccgugaaccagcccgugaaguucacccccgugggccugaacgacaccgagcacuucaaccaguggguggugcccagauacgccggcgcccugaaccugaacaccaaccuggcccccagcguggcccccguguuccccggcgagagacugcuguucuucagaagcuacaucccccugaagggcggcuacggcaaccccgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagagugcaguga

SEQ ID NO: 22465 - RNA, 1629 nt, Artificial Sequence
  derived and/or modified sequence opt4 from VP1,_capsid_protein__Norovirus__BAL60775
augaagauggccagcaacgacgccgcccccagcaccgacggcgccgccggccuggugcccgagagcaacaacgaggugauggcccuggagcccguggccggcgccgcccuggccgcccccgugaccggccagaccaacaucaucgaccccuggaucagagccaacuucgugcaggcccccaacggcgaguucaccgugagccccagaaacgcccccggcgaggugcugcugaaccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccaucgagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauuccccgugagcaucgaccagauguacaccagccccaacgaggugaucagcgugcagugccagaacggcagaugcacccuggacggcgagcugcagggcaccacccagcugcaggugagcggcaucugcgccuucaagggcgaggugaccgcccaccugcacgacaacgaccaccuguacaacaucaccaucaccaaccugaacggcagccccuucgaccccagcgaggacauccccgccccccugggcgugcccgacuuccagggcagaguguucggcaucaucagccagagagacaagcacaacagccccggccacaacgagcccgccaacagaggccacgacgccguggugcccaccuacaccgcccaguacacccccaagcugggccagauccagaucggcaccuggcagaccgacgaccugaccgugagccagcccgugaaguucacccccgugggccugaacgacaccgagcacuucaaccaguggguggugcccagauacgccggcgcccugaaccugaacaccaaccuggcccccagcguggcccccguguuccccggcgagagacugcuguucuucagaagcuacaucccccugaagggcggcuacggcaaccccgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagagugcaguga

SEQ ID NO: 22466 - RNA, 1629 nt, Artificial Sequence; identical to SEQ ID NO: 22465
  derived and/or modified sequence opt4 from VP1,_capsid_protein__Norovirus__BAL60777

SEQ ID NO: 22467 - RNA, 1629 nt, Artificial Sequence; identical to SEQ ID NO: 22465
  derived and/or modified sequence opt4 from VP1,_capsid_protein__Norovirus__BAL60779

SEQ ID NO: 22468 - RNA, 1629 nt, Artificial Sequence
  derived and/or modified sequence opt4 from VP1,_capsid_protein__Norovirus__BAL60781
augaagauggccagcaacgacgccgcccccagcaccgacggcgccgccggccuggugcccgagagcaacaacgaggugauggcccuggagcccguggccggcgccgcccuggccgcccccgugaccggccagaccaacaucaucgaccccuggaucagagccaacuucgugcaggcccccaacggcgaguucaccgugagccccagaaacgcccccggcgaggugcugcugaaccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccguggagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauuccccgugagcaucgaccagauguacaccagccccaacgaggugaucagcgugcagugccagaacggcagaugcacccuggacggcgagcugcagggcaccacccagcugcaggugagcggcaucugcgccuucaagggcgaggugaccgcccaccugcacgacaacgaccaccuguacaacgugaccaucaccaaccugaacggcagccccuucgaccccagcgaggacauccccgccccccugggcgugcccgacuuccagggcagaguguucggcaucgugagccagagagacaagcacaacagccccggccacaacgagcccgccaacagaggccacgacgccguggugcccaccuacaccgcccaguacacccccaagcugggccagauccagaucggcaccuggcagaccgacgaccugaccgugaaccagcccgugaaguucacccccgugggccugaacgacaucgagcacuucaaccaguggguggugcccagauacgccggcgcccugaaccugaacaccaaccuggcccccagcguggcccccguguuccccggcgagagacugcuguucuucagaagcuacaucccccugaagggcggcuacggcaaccccgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagagugcaguga

SEQ ID NO: 22469 - RNA, 1629 nt, Artificial Sequence
  derived and/or modified sequence opt4 from VP1,_capsid_protein__Norovirus__BAL60783
augaagauggccagcaacgacgccgcccccagcaccgacggcgccgccggccuggugcccgagagcaacaacgaggugauggcccuggagcccguggccggcgccgcccuggccgcccccgugaccggccagaccaacaucaucgaccccuggaucagagccaacuucgugcaggcccccaacggcgaguucaccgugagccccagaaacagccccggcgaggugcugcugaaccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccguggagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauuccccgugagcaucgaccagauguacaccagccccaacgaggugaucagcgugcagugccagaacggcagaugcacccuggacggcgagcugcagggcaccacccagcugcaggugagcggcaucugcgccuucaagggcgaggugaccgcccaccugcacgacaacgagcaccuguacaacgugaccaucaucaaccugaacggcagccccuucgaccccagcgaggacauccccgccccccugggcgugcccgacuuccagggcagaguguucggcgugaucagccagagagacaagcacaacacccccggccacaacgagcccgccaacagagcccacgacgccguggugcccaccuacaccgcccaguacacccccaagcugggccagauccagaucggcaccuggcagaccgacgaccugaccaacaaccagcccgugaaguucacccccgugggccugaacgacaccgagcacuucgaccaguggguggugcccagauacgccggcgcccugaaccugaacaccaaccuggcccccagcguggcccccguguuccccggcgagagacugcuguucuucagaagcuacaucccccugaagggcggcuacggcacccccgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagaauccaguga

SEQ ID NO: 22470 - RNA, 1629 nt, Artificial Sequence
  derived and/or modified sequence opt4 from VP1,_capsid_protein__Norovirus__BAL60785
augaagauggccagcaacgacgccgcccccagcaccgacggcgccgccggccuggugcccgagagcaacaacgaggugauggcccuggagcccguggccggcgccgcccuggccgcccccgugaccggccagaccaacaucaucgaccccuggaucagagccaacuucgugcaggcccccaacggcgaguucaccgugagccccagaaacgcccccggcgaggugcugcugaaccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccaucgagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauuccccgugagcaucgaccagauguacaccagccccaacgaggugaucagcgugcagugccagaacggcagaugcacccuggacggcgagcugcagggcaccacccagcugcaggugagcggcaucugcgccuucaagggcgaggugaccgcccaccugcacgacaacgaccaccuguacaacgugaccaucaccaaccugaacggcagccccuucgaccccagcgaggacauccccgccccccugggcgugcccgacuuccagggcagaguguucggcaucaucagccagagagacaagcacaacagccccggccagaacgagcccgccaacagaggccacgacgccguggugcccaccuacaccgcccaguacacccccaagcugggccagauccagaucggcaccuggcagaccgacgaccugaccgugagccagcccgugaaguucacccccgugggccugaacgacaccgagcacuucaaccaguggguggugcccagauacgccggcgcccugaaccugaacaccaaccuggcccccagcguggcccccguguuccccggcgagagacugcuguucuucagaagcuacaucccccugaagggcggcuacggcaaccccgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagagugcaguga

SEQ ID NO: 22471 - RNA, 1629 nt, Artificial Sequence; identical to SEQ ID NO: 22465
  derived and/or modified sequence opt4 from VP1,_capsid_protein__Norovirus__BAL60791

SEQ ID NO: 22472 - RNA, 1629 nt, Artificial Sequence; identical to SEQ ID NO: 22465
  derived and/or modified sequence opt4 from VP1,_capsid_protein__Norovirus__BAL60793

SEQ ID NO: 22473 - RNA, 1629 nt, Artificial Sequence; identical to SEQ ID NO: 22465
  derived and/or modified sequence opt4 from VP1,_capsid_protein__Norovirus__BAL60795

SEQ ID NO: 22474 - RNA, 1629 nt, Artificial Sequence; identical to SEQ ID NO: 22465
  derived and/or modified sequence opt4 from VP1,_capsid_protein__Norovirus__BAL60797

SEQ ID NO: 22475 - RNA, 1629 nt, Artificial Sequence
  derived and/or modified sequence opt4 from VP1,_capsid_protein__Norovirus__BAL60799
augaagauggccagcaacgacgccgcccccagcaccgacggcgccgccggccuggugcccgagagcaacaacgaggugauggcccuggagcccguggccggcgccgcccuggccgcccccgugaccggccagaccaacaucaucgaccccuggaucagagccaacuucgugcaggcccccaacggcgaguucaccgugagccccagaaacagccccggcgaggugcugcugaaccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccguggagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauuccccgugagcaucgaccagauguacaccagccccaacgaggugaucagcgugcagugccagaacggcagaugcacccuggacggcgagcugcagggcaccacccagcugcaggugagcggcaucugcgccuucaagggcgaggugaccgcccaccugcacgacaacgaccaccuguacaacgugaccaucaccaaccugaacggcagccccuucgaccccagcgaggacauccccgccccccugggcgugcccgacuuccagggcagaguguucggcgugaucagccagagagacaagcacaacacccccggccacaacgagcccgccaacagagcccacgacgccguggugcccaccuacaccgcccaguacacccccaagcugggccagauccagaucggcaccuggcagaccgacgaccugaccgugaaccagcccgugaacuucacccccgccggccugagcgacaccgaccacuucaaccaguggguggugcccagauacgccggcgcccugaaccugaacaccaaccuggcccccagcguggcccccguguuccccggcgagagacugcuguucuucagaagcuacaucccccugaagggcggcuacggcacccccgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagaauccaguga

SEQ ID NO: 22476 - RNA, 1629 nt, Artificial Sequence; identical to SEQ ID NO: 22465
  derived and/or modified sequence opt4 from VP1,_capsid_protein__Norovirus__BAL60801

SEQ ID NO: 22477 - RNA, 1629 nt, Artificial Sequence; identical to SEQ ID NO: 22465
  derived and/or modified sequence opt4 from VP1,_capsid_protein__Norovirus__BAL60803

SEQ ID NO: 22478 - RNA, 1629 nt, Artificial Sequence
  derived and/or modified sequence opt4 from VP1,_capsid_protein__Norovirus__BAL60805
augaagauggccagcaacgacgccgcccccagcaccgacggcgccgccggccuggugcccgagagcaacaacgaggugauggcccuggagcccguggccggcgccgcccuggccgcccccgugaccggccagaccaacaucaucgaccccuggaucagagccaacuucgugcaggcccccaacggcgaguucaccgugagccccagaaacgcccccggcgaggugcugcugaaccuggagcugggccccgagcugaaccccuaccuggcccaccuggccagaauguacaacggccacgccggcggcauggaggugcaggugaugcuggccggcaacgccuucaccgccggcaagcugguguucgccgccgugcccccccacuuccccaucgagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauuccccgugagcaucgaccagauguacaccagccccaacgaggugaucagcgugcagugccagaacggcagaugcacccuggacggcgagcugcagggcaccacccagcugcaggugagcggcaucugcgccuucaagggcgaggugaccgcccaccugcacgacaacgaccaccuguacaacaucaccaucaccaaccugaacggcagccccuucgaccccagcgaggacauccccgccccccugggcgugcccgacuuccagggcagaguguucggcaucaucagccagagagacaagcacaacagccccggccacaacgagcccgccaacagaggccacgacgccguggugcccaccuacaccgcccaguacacccccaagcugggccagauccagaucggcaccuggcagaccgacgaccugaccgugagccagcccgugaaguucacccccgugggccugaacgacaccgagcacuucaaccaguggguggugcccagauacgccggcgcccugaaccugaacaccaaccuggcccccagcguggcccccguguuccccggcgagagacugcuguucuucagaagcuacaucccccugaagggcggcuacggcaaccccgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagagugcaguga

SEQ ID NO: 22479 - RNA, 1629 nt, Artificial Sequence
  derived and/or modified sequence opt4 from VP1,_capsid_protein__Norovirus__BAL60809
augaagauggccagcaacgacgccgcccccagcaccgacggcgccgccggccuggugcccgagagcaacaacgaggugauggcccuggagcccguggccggcgccgcccuggccgcccccgugaccggccagaccaacaucaucgaccccuggaucagagccaacuucgugcaggcccccaacggcgaguucaccgugagccccagaaacagccccggcgaggugcugcugaaccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccguggagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauuccccgugagcaucgaccagauguacaccagccccaacgaggugaucagcgugcagugccagaacggcagaugcacccuggacggcgagcugcagggcaccacccagcugcaggugagcggcaucugcgccuucaagggcgaggugaccgcccaccugcacgacaacgaccaccuguacaacgugaccaucaccaaccugaacggcagccccuucgaccccagcgaggacauccccgccccccugggcgugcccgacuuccagggcagaguguucggcgugaucagccagagagacaagcacaacacccccggccacaacgagcccgccaacagagcccacgacgccguggugcccaccuacaccgcccaguacacccccaagcugggccagauccagaucggcaccuggcagaccgacgaccugaccgugaaccagcccgugaacuucacccccgugggccugagcgacaccgaccacuucaaccaguggguggugcccagauacgccggcgcccugaaccugaacaccaaccuggcccccagcguggcccccguguuccccggcgagagacugcuguucuucagaagcuacaucccccugaagggcggcuacggcacccccgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagaauccaguga

SEQ ID NO: 22480 - RNA, 1629 nt, Artificial Sequence
  derived and/or modified sequence opt4 from VP1,_capsid_protein__Norovirus__BAL60811
augaagauggccagcaacgacgccgcccccagcaccgacggcgccgccggccuggugcccgagagcaacaacgaggugauggcccuggagcccguggccggcgccgcccuggccgcccccgugaccggccagaccaacaucaucgaccccuggaucagagccaacuucgugcaggcccccaacggcgaguucaccgugagccccagaaacgcccccggcgaggugcugcugaaccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccguggagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauuccccgugagcaucgaccagauguacaccagccccaacgaggugaucagcgugcagugccagaacggcagaugcacccuggacggcgagcugcagggcaccacccagcugcaggugagcggcaucugcgccuucaagggcgaggugaccgcccaccugcacgacaacgaccaccuguacaacaucaccaucaccaaccugaacggcagccccuucgaccccagcgaggacauccccgccccccugggcgugcccgacuuccagggcagaguguucggcaucaucagccagagagacaagcacaacagccccggccacaacgagcccgccaacagaggccacgacgccguggugcccaccuacaccgcccaguacacccccaagcugggccagauccagaucggcaccuggcagaccgacgaccugaccgugagccagcccgugaaguucacccccgugggccugaacgacaccgagcacuucaaccaguggguggugcccagauacgccggcgcccugaaccugaacaccaaccuggcccccagcguggcccccguguuccccggcgagagacugcuguucuucagaagcuacaucccccugaagggcggcuacggcgaccccgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagagugcaguga

SEQ ID NO: 22481 - RNA, 1629 nt, Artificial Sequence; identical to SEQ ID NO: 22480
  derived and/or modified sequence opt4 from VP1,_capsid_protein__Norovirus__BAL60813

SEQ ID NO: 22482 - RNA, 1629 nt, Artificial Sequence; identical to SEQ ID NO: 22479
  derived and/or modified sequence opt4 from VP1,_capsid_protein__Norovirus__BAL60815

SEQ ID NO: 22483 - RNA, 1629 nt, Artificial Sequence
  derived and/or modified sequence opt4 from VP1,_capsid_protein__Norovirus__BAL60817
augaagauggccagcaacgacgccgcccccagcaccgacggcgccgccggccuggugcccgagagcaacaacgaggugauggcccuggagcccguggccggcgccgcccuggccgcccccgugaccggccagaccaacaucaucgaccccuggaucagagccaacuucgugcaggcccccaacggcgaguucaccgugagccccagaaacgcccccggcgaggugcugcugaaccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccaucgagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauuccccgugagcaucgaccagauguacaccagccccaacgaggugaucagcgugcagugccagaacggcagaugcacccuggacggcgagcugcagggcaccacccagcugcaggugagcggcaucugcgccuucaagggcgaggugaccgcccaccugcacgacaacgaccaccuguacaacaucaccaucaccaaccugaacggcagccccuucgaccccagcgaggacauccccgccccccugggcgugcccgacuuccagggcagaguguucggcaucaucagccagagagacaagcacaacagccccggccacaacgagcccgccaacagaggccacgacgccguggugcccaccuacaccgcccaguacacccccaagcugggccagauccagaucggcaccuggcagaccgacgaccugaccgugagccagcccgugaaguucgcccccgugggccugaacgacaccgagcacuucaaccaguggguggugcccagauacgccggcgcccugaaccugaacaucaaccuggcccccagcguggcccccguguuccccggcgagagacugcuguucuucagaagcuacaucccccugaagggcggcuacggcaaccccgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagagugcaguga

SEQ ID NO: 22484 - RNA, 1629 nt, Artificial Sequence; identical to SEQ ID NO: 22465
  derived and/or modified sequence opt4 from VP1,_capsid_protein__Norovirus__BAL60819

SEQ ID NO: 22485 - RNA, 1629 nt, Artificial Sequence; identical to SEQ ID NO: 22465
  derived and/or modified sequence opt4 from VP1,_capsid_protein__Norovirus__BAL60821

SEQ ID NO: 22486 - RNA, 1629 nt, Artificial Sequence
  derived and/or modified sequence opt4 from VP1,_capsid_protein__Norovirus__BAL60823
augaagauggccagcaacgacgccgcccccagcaccgacggcgccgccggccuggugcccgagagcaacaacgaggugauggcccuggagcccguggccggcgccgcccuggccgcccccgugaccggccagaccaacaucaucgaccccuggaucagagccaacuucgugcaggcccccaacggcgaguucaccgugagccccagaaacgcccccggcgaggugcugcugaaccuggagcugggccccgagcugaaccccuaccuggcccaccuggccagaauguacaacggcuacgccggcggccuggaggugcaggugaugcuggccggcaacgccuucaccgccggcaagcugguguucgccgccgugcccccccacuuccccaucgagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauuccccgugagcaucgaccagauguacaccagccccaacgaggugaucagcgugcagugccagaacggcagaugcacccuggacggcgagcugcagggcaccacccagcugcaggugagcggcaucugcgccuucaagggcgaggugaccgcccaccugcacgacaacgaccaccuguacaacaucaccaucaccaaccugaacggcagccccuucgaccccagcgaggacauccccgccccccugggcgugcccgacuuccagggcagaguguucggcaucaucagccagagagacaagcacaacagccccggccacaacgagcccgccaacagaggccacgacgccguggugcccaccuacaccgcccaguacacccccaagcugggccagauccagaucggcaccuggcagaccgacgaccugaccgugagccagcccgugaaguucacccccgugggccugaacgacaccgagcacuucaaccaguggguggugcccagauacgccggcgcccugaaccugaacaccaaccuggcccccagcguggcccccguguuccccggcgagagacugcuguucuucagaagcuacaucccccugaagggcggcuacggcaaccccgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagagugcaguga

SEQ ID NO: 22487 - RNA, 1629 nt, Artificial Sequence
  derived and/or modified sequence opt4 from VP1,_capsid_protein__Norovirus__BAL60825
augaagauggccagcaacgacgccgcccccagcaccgacggcgccgccggccuggugcccgagagcaacaacgaggugauggcccuggagcccguggccggcgccgcccuggccgcccccgugaccggccagaccaacaucaucgaccccuggaucagagccaacuucgugcaggcccccaacggcgaguucaccgugagccccagaaacagccccggcgaggugcugcugaaccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccguggagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagagcuucacccugcccauccugacccugggcgagcugagcaacagcagauuccccgugagcaucgaccagauguacaccagccccaacgaggugaucagcgugcagugccagaacggcagaugcacccuggacggcgagcugcagggcaccacccagcugcaggugagcggcaucugcgccuucaagggcgaggugaccgcccaccugcacgacaacgaccaccuguacaacgugaccaucaccaaccugaacggcagccccuucgaccccagcgaggacauccccgccccccugggcgugcccgacuuccagggcagaguguucggcgugaucagccagagagacaagcacaacacccccggccacaacgagcccgccaacagagcccacgacgccguggugcccaccuacaccgcccaguacacccccaagcugggccagauccagaucggcaccuggcagaccgacgaccugaccgugaaccagcccgugaacuucacccccgugggccugagcgacaccgaccacuucaaccaguggguggugcccagauacgccggcgcccugaaccugaacaccaaccuggcccccagcguggcccccguguuccccggcgagagacugcuguucuucagaagcuacaucccccugaagggcggcuacggcacccccgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagaauccaguga

SEQ ID NO: 22488 - RNA, 1629 nt, Artificial Sequence; identical to SEQ ID NO: 22465
  derived and/or modified sequence opt4 from VP1,_capsid_protein__Norovirus__BAL60827

SEQ ID NO: 22489 - RNA, 1629 nt, Artificial Sequence; identical to SEQ ID NO: 22465
  derived and/or modified sequence opt4 from VP1,_capsid_protein__Norovirus__BAL60829

SEQ ID NO: 22490 - RNA, 1629 nt, Artificial Sequence; identical to SEQ ID NO: 22465
  derived and/or modified sequence opt4 from VP1,_capsid_protein__Norovirus__BAL60831

SEQ ID NO: 22491 - RNA, 1629 nt, Artificial Sequence
  derived and/or modified sequence opt4 from VP1,_capsid_protein__Norovirus__BAL60833
augaagauggccagcaacgacgccgcccccagcaccgacggcgccgccggccuggugcccgagagcaacaacgaggugauggcccuggagcccguggccggcgccgcccuggccgcccccgugaccggccagaccaacaucaucgaccccuggaucagagccaacuucgugcaggcccccaacggcgaguucaccgugagccccagaaacagccccggcgaggugcugcugaaccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccguggagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauuccccgugagcaucgaccagauguacaccagccccaacgaggugaucagcgugcagugccagaacggcagaugcacccuggacggcgagcugcagggcaccacccagcugcaggugagcggcaucugcgccuucaagggcgaggugaccgcccaccugcacgacaacgaccaccuguacaacgugaccaucaccaaccugaacggcagccccuucgaccccagcgaggacauccccgccccccugggcgugcccgacuuccagggcagaguguucggcgugaucagccagagagacaagcacaacacccccggccacaacgagcccgccaacagagcccacgacgccguggugcccaccuacaccgcccaguacacccccaagcugggccagauccagaucggcaccuggcagaccgacgaccugaccgugaaccagcccgugaacuucacccccgugggccugaacgacaccgaccacuucaaccaguggguggugcccagauacgccggcgcccugaaccugaacaccaaccuggcccccagcguggcccccguguuccccggcgagagacugcuguucuucagaagcuacaucccccugaagggcggcuacggcacccccgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagaauccaguga

SEQ ID NO: 22492 - RNA, 1629 nt, Artificial Sequence
  derived and/or modified sequence opt4 from VP1,_capsid_protein__Norovirus__BAL60835
augaagauggccagcaacgacgccgcccccagcaccgacggcgccgccggccuggugcccgagagcaacaacgaggugauggcccuggagcccguggccggcgccgcccuggccgcccccgugaccggccagaccaacaucaucgaccccuggaucagagccaacuucgugcaggcccccaacggcgaguucaccgugagccccagaaacagccccggcgaggugcugcugaaccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccguggagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauuccccgugagcaucgaccagauguacaccagccccaacgaggugaucagcgugcagugccagaacggcagaugcacccuggacggcgagcugcagggcaccacccagcugcaggugagcggcaucugcgccuucaagggcgaggugaccgcccaccugcacgacaacgaccaccuguacaacgugaccaucaccaaccugaacggcagccccuucgaccccagcgaggacauccccgccccccugggcgugcccgacuuccagggcagaguguucggcgugaucagccagagagacaagcacaacacccccggccacaacgagcccgccaacagagcccacgacgccguggugcccaccuacaccgcccaguacacccccaagcugggccagauccagaucggcaccuggcagaccgacgaccugaccgugaaccagcccgccaacuucacccccgugggccugagcgacaccgaccacuucaaccaguggguggugcccagauacgccggcgcccugaaccugaacaccaaccuggcccccagcguggcccccguguuccccggcgagagacugcuguucuucagaagcuacaucccccugaagggcggcuacggcacccccgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagaauccaguga

SEQ ID NO: 22493 - RNA, 1629 nt, Artificial Sequence; identical to SEQ ID NO: 22479
  derived and/or modified sequence opt4 from VP1,_capsid_protein__Norovirus__BAL60837

SEQ ID NO: 22494 - RNA, 1629 nt, Artificial Sequence; identical to SEQ ID NO: 22479
  derived and/or modified sequence opt4 from VP1,_capsid_protein__Norovirus__BAL60839

SEQ ID NO: 22495 - RNA, 1629 nt, Artificial Sequence
  derived and/or modified sequence opt4 from VP1,_capsid_protein__Norovirus__BAL60841
augaagauggccagcaacgacgccgcccccagcaccgacggcgccgccggccuggugcccgagagcaacaacgaggugauggcccuggagcccguggccggcgccgcccuggccgcccccgugaccggccagaccaacaucaucgaccccuggaucagagccaacuucgugcaggcccccaacggcgaguucaccgugagccccagaaacagccccggcgaggugcugcugaaccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccguggagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauuccccgugagcaucgaccagauguacaccagccccaacgaggugaucagcgugcagugccagaacggcagaugcacccuggacggcgagcugcagggcaccacccagcugcaggugagcggcaucugcgccuucaagggcgaggugaccgcccaccugcacgacaacgaccaccuguacaacgugaccaucaccaaccugaacggcagccccuucgaccccagcgaggacauccccgccccccugggcgugcccgacuuccagggcagaguguucggcgugaucagccagagagacaagcacaacacccccggccacaacgagcccgccaacagagcccacgacgccguggugcccaccuacaccgcccaguacacccccaagcugggccagauccagaucggcaccuggcagaccgacgaccugaccgugaaccagcccgugaaguucacccccgugggccugaacgacaccgaccacuucaaccaguggguggugcccagauacgccggcgcccugaaccugaacaccaaccuggcccccagcguggcccccguguuccccggcgagagacugcuguucuucagaagcuacaucccccugaagggcggcuacggcaccagcgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagaauccaguga

SEQ ID NO: 22496 - RNA, 1629 nt, Artificial Sequence; identical to SEQ ID NO: 22465
  derived and/or modified sequence opt4 from VP1,_capsid_protein__Norovirus__BAL60843

SEQ ID NO: 22497 - RNA, 1629 nt, Artificial Sequence; identical to SEQ ID NO: 22491
  derived and/or modified sequence opt4 from VP1,_capsid_protein__Norovirus__BAL60845

SEQ ID NO: 22498 - RNA, 1629 nt, Artificial Sequence; identical to SEQ ID NO: 22479
  derived and/or modified sequence opt4 from VP1,_capsid_protein__Norovirus__BAL60847

SEQ ID NO: 22499 - RNA, 1629 nt, Artificial Sequence
  derived and/or modified sequence opt4 from VP1,_capsid_protein__Norovirus__BAL60849
augaagauggccagcaacgacgccgcccccagcaccgacggcgccgccggccuggugcccgagagcaacagcgaggugauggcccuggagcccguggccggcgccgcccuggccgcccccgugaccggccagaccaacaucaucgaccccuggaucagagccaacuucgugcaggcccccaacggcgaguucaccgugagccccagaaacgcccccggcgaggugcugcugaaccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccaucgagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauuccccgugagcaucgaccagauguacaccagccccaacgaggugaucagcgugcagugccagaacggcagaugcacccuggacggcgagcugcagggcaccacccagcugcaggugagcggcaucugcgccuucaagggcgaggugaccgcccaccugcacgacaacgaccaccuguacaacaucaccaucaccaaccugaacggcagccccuucgaccccagcgaggacauccccgccccccugggcgugcccgacuuccagggcagaguguucggcaucaucagccagagagacaagcacaacagccccggccacaacgagcccgccaacagaggccacgacgccguggugcccaccuacaccgcccaguacacccccaagcugggccagauccagaucggcaccuggcagaccgacgaccugaccgugagccagcccgugaaguucacccccgugggccugaacgacaccgagcacuucaaccaguggguggugcccagauacgccggcgcccugaaccugaacaccaaccuggcccccagcguggcccccguguuccccggcgagagacugcuguucuucagaagcuacaucccccugaagggcggcuacggcaaccccgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagagugcaguga

SEQ ID NO: 22500 - RNA, 1629 nt, Artificial Sequence; identical to SEQ ID NO: 22465
  derived and/or modified sequence opt4 from VP1,_capsid_protein__Norovirus__BAL60851

SEQ ID NO: 22501 - RNA, 1647 nt, Artificial Sequence
  derived and/or modified sequence opt4 from VP1__Norovirus__AAT00378
augaagauggccagcaacgacgccacccccagcaacgacggcgccgccggccuggugcccgagaucaacaacgaggccauggcccuggaccccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgccuucaccgccggcaagaucaucuucgccgccaucccccccaacuuccccaucgacaaccugagcgccgcccagaucaccaugugcccccacgugaucguggacgugagacagcuggagcccgugaaccugcccaugcccgacgugagaaacaacuucuuccacuacaaccagggcagcgacagcagacugagacugaucgccaugcuguacaccccccugagagccaacaacagcggcgacgacguguucaccgugagcugcagagugcugaccagacccagccccgacuucagcuucaacuuccuggugccccccaccguggagagcaagaccaagcccuucacccugcccauccugaccaucagcgagaugagcaacagcagauuccccgugcccaucgacagccugcacaccagccccaccgagaacaucguggugcagugccagaacggcagagugacccuggacggcgagcugaugggcaccacccagcugcugcccagccagaucugcgccuucagaggcgugcugaccagaagcaccagcagagccagcgaccaggccgacaccgugacccccagacuguucaacuacuacuggcacauccagcuggacaaccugaacggcacccccuacgaccccgccgaggacauccccggcccccugggcacccccgacuucagaggcaagguguucggcguggccagccagagaaaccccgacagcaccaccagagcccacgaggccaagguggacaccaccgccggcagauucacccccaagcugggcagccuggagaucagcaccgagagcgacgacuucgaccagaaccagcccaccagauucgcccccgugggcaucggcguggacagagaggccggcuuccagcaguggagccugcccgacuacagcggccaguucagcagaaucaugagccuggcccccgccguggcccccaucuuccccggcgagcagcugcuguucuucagaagccagcugcccagcagcggcggcagaagcaacggcauccuggacugccuggugccccaggagugggugcagcacuucuaccaggagagcgcccccgcccagacccagguggcccuggugagauacgugaaccccgacaccggcagagugcuguucgaggccaagcugcacaagcugggcuucaugaccaucgccaagaacggcgacagccccaucaccgugccccccaacggcuacuucagauucgagagcugggugaaccccuucuacacccuggcccccaugggcaccggcaacggcagaagaagaauccaguga

SEQ ID NO: 22502 - RNA, 1626 nt, Artificial Sequence
  derived and/or modified sequence opt4 from VP1__Norovirus__ABD95934
augaagauggccagcaacgacgccgcccccagcaacgacggcgccgccggccuggugcccgagaucaacaccgagacccugccccuggagcccguggccggcgccgcccuggccgccgccgugaccggccagagcaacaucaucgaccccuggaucagaaccaacuucgugcaggcccccaacggcgaguucaccgugagccccagaaacagccccggcgaggugcugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacaacaacagacccagcgagagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucagccugcccauccugaccaucagcgagcugaccaacagcagauuccccgcccccaucgacagccuguucaccgcccagaacaacaaccugaacgugcagugccagaacggcagaugcacccuggacggcgagcugcagggcaccacccagcugcugcccaccggcaucugcgccuucagaggcaagaucagcgccgacgugcagaacagccaccaggacagauggcacaugcagcugaccaaccugaacggcacccccuucgaccccaccgacgacgugcccgccccccugggcacccccgacuucaccggccugcuguucggcguggccagccagagaaacgugggcggcaccggcaacaacaccaccagagcccacgagguggugaucgccaccaccagcacccaguucgugcccaagcugggcagcaucaacuucggcagcgagagcgaggacuuccaggugggcccccccaccaaguucacccccgugggcaucaagaucgagaccggccacagcuucagacagugggacccccccaacuacagcggcgcccugacccugaacaugaaccuggccccccccguggcccccaacuuccccggcgagcagcugcuguucuucagaagcaacgugcccugcgccggcggcgugagcgagggcaucaucgacugccugcugccccaggaguggauccagcacuucuaccaggagagcgcccccagccagagcgacguggcccugaucagauacgugaaccccgacaccggcagaacccuguucgaggccaagcugcacagaaccggcuacaucaccguggcccacagcggcgacuacccccugguggugcccagcaacggcuacuucagauucgacagcuggaucaaccaguucuacagccuggcccccaugggcaccggcaacggcagaagaagagugcaguga

SEQ ID NO: 22503 - RNA, 1623 nt, Artificial Sequence
  derived and/or modified sequence opt4 from VP1__Norovirus__ABG49509
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccgacacccacaacuacaccaugaaccuggccagccagaacuggaacaacuacgaccccaccgaggagauccccgccccccugggcacccccgacuucgugggcaagauccagggcaugcugacccagaccaccagaggcgacggcagcaccagaggccacaaggccaccgugagcaccggcgacgugcacuucacccccaagcugggcagcauccaguucaacaccgacaccaacaacgacuucgagaccggccagaacaccaaguucacccccgugggcguggugcaggacggcaacggcacccaccagaacgagccccagcagugggugcugcccagcuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22504 - RNA, 1623 nt, Artificial Sequence
  derived and/or modified sequence opt4 from VP1__Norovirus__ABP88833
augaagauggccaccaacgacgccagccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgagguggaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgcccugguggugcagccccagaacggcagaugcaccaccgacggcgugcugcugggcaccacccagcugagccccgugaacaucugcaccuucagaggcgacgugacccacaucagcggcaccagaaccuacagaaugaaccuggccagccagaacuggaacaacuacgaccccaccgaggagauccccgccccccugggcacccccgacuucgugggcaagauccagggcaugcugacccagaccaccaagggcgacggcagcaccagaggccacaaggccaccgugagcaccggcagcguggacuucacccccaagcugggcagcgugcaguucgccaccgacaccgacaacgacuucgagaccggccagaacaccagauucacccccgugggcgugauccaggacggcagcagcgcccacagaaacgagccccagcagugggugcugcccgacuacagcggcagaaccgugcacaacgugcaccuggcccccgccguggcccccaccuuccccggcgagcagcugcccuucuucagaagcaccaugcccggcugcagcggcuaccccaacauggaccuggacugccugcugccccaggagugggugcagcacuucuaccaggaggccgcccccagccagagcgacguggcccugcugagauucgugaaccccgacaccggcagagugcuguucgagugcaagcugcacaaggccggcuacgugaccguggcccacaccggccagcacgaccuggugaucccccccaacggcuacuucagauucgacagcugggugaaccagagcuacacccuggcccccaugggcaacggcgccggcagaagaagagcccuguga

SEQ ID NO: 22505 - RNA, 1623 nt, Artificial Sequence
  derived and/or modified sequence opt4 from VP1__Norovirus__ABY27560
augaagauggccagcagcgacgccagccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcacccacgacuacaccaugaaccuggccagccagaacuggaacaacuacgaccccaccgaggagauccccgccccccugggcacccccgacuucgugggcaagauccagggcgugcugacccagaccaccagaggcgacggcagcaccagaggccacaaggccaccgugagcaccggcagcgugcacuucacccccaagcugggcagcgugcaguucaccaccgacaccaacaacgaccuggagaccggccagaacaccaaguucacccccgugggcguggugcaggacggcaacagcgcccaccagaacgagccccagcagugggugcugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcugcacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcgccggcagaagaagagcccuguga

SEQ ID NO: 22506 - RNA, 1620 nt, Artificial Sequence
  derived and/or modified sequence opt4 from VP1__Norovirus__ACT76139
augaagauggccagcagcgacgccaaccccagcgacggcagcgccgccaaccuggugcccgaggugaacaacgaggugauggcccuggagcccguggugggcgccgccaucgccgcccccguggccggccagcagaacaucaucgaccccuggaucagaaacaacuucgugcaggcccccggcggcgaguucaccgugagccccagaaacgcccccggcgagauccuguggagcgccccccugggccccgaccugaaccccuaccugagccaccugagcagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccaggcccacgacagcacccugaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaacuucagaggcgacgugaccagagugggcaucagccacgacuacaccaugaaccuggugagccagaacuggaacaacuacgaccccaccgaggagauccccgccccccugggcacccccgacuucgugggcaagauccagggccugcugacccagaccaccagagccgacggcagcaccagagcccacaaggccaccgugagcaccggcagcgugcacuucacccccaagcugggcagcgugcaguucaccaccgacaccaacaacgacuuccagaccggccagaacaccaaguucacccccgugggcgugauccaggacggcgaccaccaccagaacgagccccagcagugggugcugcccaacuacagcggcaccagcggccacaacgugcaccuggcccccgccguggcccccaccuuccccggcgagcagcugcuguucuucagaagcaccaugcccggcugcagcggcuaccccaacaugaaccuggacugccugcugccccaggagugggugcugcacuucuaccaggaggccgcccccgcccagagcgacguggcccugcugagauucgugaaccccgacaccggcagagugcuguucgagugcaagcugcacaagagcggcuacaucaccguggcccacaccggccccuacgaccuggugaucccccccaacggcuacuucagauucgacagcugggugaaccaguucuacacccuggcccccaugggcaacggcaccggcagaagaagagcccuguga

SEQ ID NO: 22507 - RNA, 1620 nt, Artificial Sequence
  derived and/or modified sequence opt4 from VP1__Norovirus__ACT76142
augaagauggccagcagcgacgccaaccccagcgacggcagcaccgccaaccuggugcccgaggugaacaacgaggugauggcccuggagcccguggugggcgccgccaucgccgcccccguggccggccagcagaacaucaucgaccccuggaucagaaacaacuucgugcaggcccccggcggcgaguucaccgugagccccagaaacgcccccggcgagauccuguggagcgccccccugagccccgaccugaaccccuaccugagccaccugagcagaauguacaacggcuacgccggcggcuucgaggugcaggugauccuggccggcaacgccuucaccgccggcaagaucaucuucgccgccaucccccccaacuuccccaccgagggccugagccccagccaggugaccauguucccccacaucaucguggacgugagacagcuggagcccgugcugaucccccugcccgacgugagaaacaacuucuaccacuacaaccaggcccacgacagcacccugaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaacuucagaggcgacgugaccagagugggcaucagccacgacuacaccaugaaccuggugagccagaacuggaacaacuacgaccccaccgaggagauccccgccccccugggcacccccgacuucgugggcaagauccagggccugcugacccagaccaccagagccgacggcagcaccagagcccacaaggccaccgugagcaccggcagcgugcacuucacccccaagcugggcagcgugcaguucaccaccgacaccaacaacgacuuccagaccggccagaacaccaaguucacccccgugggcgugauccaggacggcgaccaccaccagaacgagccccagcagugggugcugcccaacuacagcggcaccagcggccacaacgugcaccuggcccccgccguggcccccaccuuccccggcgagcagcugcuguucuucagaagcaccaugcccggcugcagcggcuaccccaacaugaaccuggacugccugcugccccaggagugggugagccacuucuaccaggaggccgcccccgcccagagcgacguggcccugcugagauucgugaaccccgacaccggcagagugcuguucgagugcaagcugcacaagagcggcuacaucaccguggcccacaccggccccuacgaccuggugaucccccccaacggcuacuucagauucgacagcugggugaaccaguucuacacccuggcccccaugggcaacggcagcggcagaaagagagugcuguga

SEQ ID NO: 22508 - RNA, 1620 nt, Artificial Sequence
  derived and/or modified sequence opt4 from VP1__Norovirus__ACT76145
augaagauggccagcagcgacgccaaccccagcgacggcagcgccgccaaccuggugcccgaggugaacaacgaggugauggcccuggagcccguggugggcgccgccaucgccgcccccguggccggccagcagaacaucaucgaccccuggaucagaaacaacuucgugcaggcccccggcggcgaguucaccgugagccccagaaacgcccccggcgagauccuguggagcgccccccugggccccgaccugaaccccuaccugagccaccugagcagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagccacgacagcacccugaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaacuucagaggcgacgugacccacaucgugggcagccacgacuacaccaugaaccuggugagccagaacuggagcaacuacgaccccaccgaggagauccccgccccccugggcacccccgacuucgugggcaagauccagggccugcugacccagaccaccagagccgacggcagcaccagagcccacaaggccaccgugagcaccggcagcgugcacuucacccccaagcugggcagcgugcaguucaccaccgacaccaacaacgacuuccagaccggccagaacaccaaguucacccccgugggcgugauccaggacggcgaccaccaccagaacgagccccagcagugggugcugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcugcacuucuaccaggaggccgcccccgcccagagcgacguggcccugcugagauucgugaaccccgacaccggcagagugcuguucgagugcaagcugcacaagagcggcuacaucaccguggcccacaccggccccuacgaccuggugaucccccccaacggcuacuucagauucgacagcugggugaaccaguucuacacccuggcccccaugggcaacggcaccggcagaagaagagcccuguga

SEQ ID NO: 22509 - RNA, 1620 nt, Artificial Sequence
  derived and/or modified sequence opt4 from VP1__Norovirus__ACT76148
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccugagcagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccaggcccacgacagcacccugaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaacuucagaggcgacgugacccacaucgugggcagccacgacuacaccaugaaccuggugagccagaacuggagcaacuacgaccccaccgaggagauccccgccccccugggcacccccgacuucgugggcaagauccagggccugcugacccagaccaccagagccgacggcagcaccagagcccacaaggccaccgugagcaccggcagcgugcacuucauccccaagcugggcagcgugcaguucaccaccgacaccaacaacgacuuccagaccggccagaacaccaaguucacccccgugggcgugauccaggacggcgaccaccaccagaacgagccccagcagugggugcugcccaacuacagcggcagaaccggccacaacgugcaccuggcccccgccguggcccccaccuuccccggcgagcagcugcuguucuucagaagcaccgugcccggcugcagcggcuaccccaacaugaaccuggacugccugcugccccaggagugggugagccacuucuaccaggaggccgcccccgcccagagcgacguggcccugcugagauucgugaaccccgacaccggcagagugcuguucgagugcaagcugcacaagagcggcuacaucaccguggcccacaccggccccuacgaccuggugcugccccccaacggcuacuucagauucgacagcugggugaaccaguucuacacccuggcccccaugggcaacggcaccggcagaagaagagcccuguga

SEQ ID NO: 22510 - RNA, 1620 nt, Artificial Sequence
  derived and/or modified sequence opt4 from VP1__Norovirus__ACT76151
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccugagcagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccaggcccacgacagcacccugaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaacuucagaggcgacgugaccagagugggcaucagccacgacuacaccaugaaccuggugagccagaacuggaacaacuacgaccccaccgaggagauccccgccccccugggcacccccgacuucgugggcaagauccagggccugcugacccagaccaccagagccgacggcagcaccagagcccacaaggccaccgugagcaccggcagcgugcacuucacccccaagcugggcagcgugcaguucaccaccgacaccaacaacgacuuccagaccggccagaacaccaaguucacccccgugggcgugauccaggacggcgaccaccaccagaacgagccccagcagugggugcugcccaacuacagcggcaccagcggccacaacgugcaccuggcccccgccguggcccccaccuuccccggcgagcagcugcuguucuucagaagcaccaugcccggcugcagcggcuaccccaacaugaaccuggacugccugcugccccaggagugggugcugcacuucuaccaggaggccgcccccgcccagagcgacguggcccugcugagauucgugaaccccgacaccggcagagugcuguucgagugcaagcugcacaagagcggcuacaucaccguggcccacaccggccccuacgaccuggugaucccccccaacggcuacuucagauucgacagcugggugaaccaguucuacacccuggcccccaugggcaacggcaccggcagaagaagagcccuguga

SEQ ID NO: 22511 - RNA, 1623 nt, Artificial Sequence
  derived and/or modified sequence opt4 from VP1__Norovirus__ACX31821
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagagacuguacaccggccccagcagcgccuucguggugcagccccagaacggcagaugcaccaccgacggcgugcugcugggcaccacccagcugagcgccgugaacaucugcaccuucagaggcgacgugacccacaucgccggcagcagaaacuacaccaugaaccuggccagccagaacuggaacaacuacgaccccaccgaggagauccccgccccccugggcacccccgacuucgugggcaagauccagggcaugcugacccagaccaccagaagcgacggcagcaccagaggccacaaggccaccguguucaccggcagcgccgacuucgcccccaagcugggcagagugcaguucgccaccgacaccgacaacgacuucgagagcggccagaacaccaaguucacccccgugggcgugauccaggacggcagcaccacccacagaaacgagccccagcagugggugcugcccaacuacagcggcagaaccggccacaacgugcaccuggcccccgccguggcccccaccuaccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22512 - RNA, 1623 nt, Artificial Sequence
  derived and/or modified sequence opt4 from VP1__Norovirus__ACX31837
augaagauggccagcaacgacgccaaccccagcgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22513 - RNA, 1623 nt, Artificial Sequence
  derived and/or modified sequence opt4 from VP1__Norovirus__ACX31841
augaagauggccagcaacgacgccaaccccagcgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcacccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22514 - RNA, 1623 nt, Artificial Sequence
  derived and/or modified sequence opt4 from VP1__Norovirus__ACX31851
augaagauggccagcaacgacgccaaccccagcaacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22515 - RNA, 1623 nt, Artificial Sequence
  derived and/or modified sequence opt4 from VP1__Norovirus__ACX31856
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgaggcccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugauccccagcaacggcuacuucagauucgacagcugggugaaccaguucuacacccuggcccccaugggcaacggcaccggcagaagaagagugcuguga

SEQ ID NO: 22516 - RNA, 1623 nt, Artificial Sequence
  derived and/or modified sequence opt4 from VP1__Norovirus__ACX31860
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagagacuacaccaugaaccuggccagccugaacuggaacaacuacgaccccaccgaggagauccccgccccccugggcacccccgacuucgugggcaagauccagggcgugcugacccagaccaccgagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22517 - RNA, 1623 nt, Artificial Sequence
  derived and/or modified sequence opt4 from VP1__Norovirus__ACX31864
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgacaugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucguggccaaccagaacaccaaguucacccccgugggcgugauccaggacggcaacaccgcccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22518 - RNA, 1623 nt, Artificial Sequence
  derived and/or modified sequence opt4 from VP1__Norovirus__ACX31889
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgacaugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgacgccaaccagaacaccaaguucacccccgugggcgugauccaggacggcaacaccgcccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22519 - RNA, 1608 nt, Artificial Sequence
  derived and/or modified sequence opt4 from VP1__Norovirus__ACX31893
augaagauggccagcaacgacgccgcccccagcaacgacggcgccgccggccuggugcccgaggugaacaacgagaccauggcccuggagcccguggccggcgccagcaucgccgccccccugaccggccagaacaacgugaucgaccccuggaucagacugaacuucgugcaggcccccaacggcgaguucaccgugagccccagaaacagccccggcgaggugcugcugaaccuggagcugggccccgagcugaaccccuaccuggcccaccugagcagaauguacaacggcuacgccggcggcguggaggugcaggugcugcuggccggcaacgccuucaccgccggcaagcugguguucgccgccgugcccccccacuucccccuggagaacaucagccccggccagaucaccauguucccccacgugaucaucgacgugagaacccuggagcccgugcugcugccccugcccgacgugagaaacaacuucuuccacuacaaccagcagaacgagcagagaaugagacugguggccaugcuguacaccccccugagaagcaacggcagcggcgacgacguguucaccgugagcugcagagugcugaccagacccagccccgacuucgacuucaacuaccuggugccccccaccguggagagcaagaccaagcccuucacccugcccauccugaccaucggcgagcugaccaacagcagauuccccgugcccaucgacgagcuguacaccagccccaacgagagccugguggugcagccccagaacggcagaugcgcccuggacggcgagcugcagggcaccacccagcugcugcccaccgccaucugcagcuucagaggcagaaucaaccagaaggugagcggcgagaaccacguguggaacaugcaggugaccaacaucaacggcacccccuucgaccccaccgaggacgugcccgccccccugggcacccccgacuucagcggcaagcuguucggcgugcugagccagagagaccacgacaacgccugcagaagccacgacgccgugaucgccaccaacagcgccaaguucacccccaagcugggcgccauccagaucggcaccugggagcaggacgacgugcacaucaaccagcccaccaaguucacccccgugggccuguucgagagcgagggcuucaaccaguggacccugcccaacuacagcggcgcccugacccugaacaugggccuggccccccccguggcccccaccuuccccggcgagcagauccuguucuucagaagccacaucccccugaagggcggcguggccgaccccgugaucgacugccugcugccccaggaguggauccagcaccuguaccaggagagcgcccccagccagaccgacguggcccugaucagauucaccaaccccgacaccggcagagugcuguucgaggccaagcugcacagaagcggcuacaucaccguggccaacaccggcagcagacccaucguggugcccgccaacggcuacuucagauucgacagcugggugaaccaguucuacagccuggcccccaugggcaccggcaacggcagaagaagagugcaguga

SEQ ID NO: 22520 - RNA, 1749 nt, Artificial Sequence
  derived and/or modified sequence opt4 from VP1__Norovirus__ACX69259
augaagauggccagcaacgacgccgccccccccagcagcgacggcgccgccaaccuggugcccgagaucaacaacgaggugauggcccuggagcccguggccggcgcccagcuggccgcccccguggccggccaguucaacgccaucgaccccuggaucagacagaacuucgugcaggcccccgagggcgaguucaccgugagccccagaaacgcccccggcgagauccugcugaaccuggagcugggcccccaccugaaccccuuccugcagcaccuggcccagauguacaacgccuacgccggcggcauggaggugcagguggugcuggccggcaacgccuucaccgccggcaagaucaucuucgccgccauccccccccacuucccccccgagagacugagcgccgcccaggccacccaguucccccacgugaucguggacgugagacagcuggagcccaucgugcugccccugcccgacgugagacacaaccuguuccacuucaaccagcagaacgacgagagaaugcaccugguggccuuccuguacaccccccugagagccaacagcggcaacggcgacgacguguucaccgugagcugcagagugcugaccagacccagccaggacuucgaguucauguuccuggugccccccaccguggagaagaagaccguggccuucagccugccccagcuggccgugggcgagaugagcaacagcagauggcccgccagaaucaccggcauggugguggaccccagacugccccaggugcugcacauccagaacggcagaugcacccuggacggcacccugaugggcaccacccagcugaaccccaacgacaucugcagaaucagaggcuacuucagcagcagcagacccgagcugcugugcgagggcgaggagagcgaggugaacaccacccccaccgacagcggcgccaccggcgaccagacccccgaggugagaaccggcaccagagccacccagagaugguucgccgugaccgagcugaacggccagguguacgaccccuucggcgaccagcccgccccccugggcgugcccgacuucaaggccagaauccugggcgcccugaugagacugcccggcaccaaccccaccagcaacagcagauucgaggacgccuggguggagaccaacaaccagaccaccuacgcccccgccaccggcgugguggccaucaccaccaacgacaacagcagcggcaacuacgccaacgaccagaccugcgaguucgugccccugggcaucgagaucaccgacagcgcccccuacaacgaguucgaccugcccagcuacggcggcgccgccagcagcggcaacagaaaccuggcccccaccguggcccccaccuuccccggcgaggccauccugcuguucggcagcaacaugcccguguacaacagaagcagcggcaccgacaacaaggacaucagaugccugcugcccaacgaguacgugcagcaccuguacgacacccaggcccccagccugagcgacguggcccuggugagauacgugaacagagacaccggcagagugcuguucgaggccaagcugcacagagacggcuucaugaccgugaacgccagcagcaccaccgugcugcccguggacggcuacuucagauucgacagcugggugaaccaguucuacgcccugagccccgugggcaacgccagcggcagaagaggcagaagcagacaggccaacuga

SEQ ID NO: 22521 - RNA, 1647 nt, Artificial Sequence
  derived and/or modified sequence opt4 from VP1__Norovirus__ADF47131
augaagauggccagcaacgacgccgcccccagcaacgacggcgccgccggccuggugcccgagaucaacaacgaggccauggcccuggagcccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgccuucaccgccggcaagaucaucuucgccgccaucccccccaacuuccccaucgacaaccugagcgccgcccagaucaccaugugcccccacgugaucguggacgugagacagcuggagcccgugaaccugcccaugcccgacgugagaaacaacuucuuccacuacaaccagggcagcgacagcagacugagacugguggccaugcuguacaccccccugagagccaacaacagcggcgacgacguguucaccgugagcugcagagugcugaccagacccagccccgacuucagcuucaacuuccuggugccccccaccguggagagcaagaccaagcccuucacccugcccauccugaccaucagcgagaugagcaacagcagauuccccgugcccaucgacagccugcacaccagccccaccgagaacaucguggugcagugccagaacggcagagugacccuggacggcgagcugaugggcaccacccagcugcugcccagccagaucugcgccuucagaggcgugcugaccagaagcaccagcagagccagcgaccaggccgacaccgccacccccagacuguucaacuacuacuggcacauccagcuggacaaccugaacggcacccccuacgaccccgccgaggacauccccggcccccugggcacccccgacuucagaggcaagguguucggcguggccagccagagaaaccccgacagcaccaccagagcccacgaggccaagguggacaccaccgccggcagauucacccccaagcugggcagccuggagaucagcaccgagagcggcgacuucaaccagaaccagcccaccagauucacccccgugggcaucggcguggaccacgaggaggacuuccagcaguggagccugcccgacuacagcggccaguucacccacaacaugaaccuggcccccgccguggcccccaacuuccccggcgagcagcugcuguucuucagaagccagcugcccagcagcggcggcagaagcaacggcauccuggacugccuggugccccaggagugggugcagcacuucuaccaggagagcgcccccacccagacccagguggcccuggugagauacgugaaccccgacaccggcagagugcuguucgaggccaagcugcacaagcugggcuucaugaccaucgccaagaacggcgacagccccaucaccgugccccccaacggcuacuucagauucgagagcugggugaaccccuucuacacccuggcccccaccggcaccgagaacggcagaagaagagugcaguga

SEQ ID NO: 22522 - RNA, 1623 nt, Artificial Sequence
  derived and/or modified sequence opt4 from VP1__Norovirus__ADR78869
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22523 - RNA, 1623 nt, Artificial Sequence
  derived and/or modified sequence opt4 from VP1__Norovirus__ADR78872
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugacccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22524 - RNA, 1623 nt, Artificial Sequence; identical to SEQ ID NO: 22522
  derived and/or modified sequence opt4 from VP1__Norovirus__ADR78875

SEQ ID NO: 22525 - RNA, 1623 nt, Artificial Sequence; identical to SEQ ID NO: 22522
  derived and/or modified sequence opt4 from VP1__Norovirus__ADR78878

SEQ ID NO: 22526 - RNA, 1623 nt, Artificial Sequence; identical to SEQ ID NO: 22522
  derived and/or modified sequence opt4 from VP1__Norovirus__ADR78881

SEQ ID NO: 22527 - RNA, 1623 nt, Artificial Sequence; identical to SEQ ID NO: 22522
  derived and/or modified sequence opt4 from VP1__Norovirus__ADR78884

SEQ ID NO: 22528 - RNA, 1623 nt, Artificial Sequence
  derived and/or modified sequence opt4 from VP1__Norovirus__ADR78887
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugagccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22529 - RNA, 1623 nt, Artificial Sequence; identical to SEQ ID NO: 22522
  derived and/or modified sequence opt4 from VP1__Norovirus__ADR78890

SEQ ID NO: 22530 - RNA, 1623 nt, Artificial Sequence; identical to SEQ ID NO: 22522
  derived and/or modified sequence opt4 from VP1__Norovirus__ADR78893

SEQ ID NO: 22531 - RNA, 1623 nt, Artificial Sequence; identical to SEQ ID NO: 22522
  derived and/or modified sequence opt4 from VP1__Norovirus__ADR78896

SEQ ID NO: 22532 - RNA, 1623 nt, Artificial Sequence
  derived and/or modified sequence opt4 from VP1__Norovirus__ADR78899
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcgcccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22533 - RNA, 1623 nt, Artificial Sequence; identical to SEQ ID NO: 22522
  derived and/or modified sequence opt4 from VP1__Norovirus__ADR78902

SEQ ID NO: 22534 - RNA, 1623 nt, Artificial Sequence; identical to SEQ ID NO: 22522
  derived and/or modified sequence opt4 from VP1__Norovirus__ADR78905

SEQ ID NO: 22535 - RNA, 1623 nt, Artificial Sequence
  derived and/or modified sequence opt4 from VP1__Norovirus__ADR78908
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22536 - RNA, 1623 nt, Artificial Sequence
  derived and/or modified sequence opt4 from VP1__Norovirus__ADR78911
augaagauggccagcaacgacgccacccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccagaacuacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcgugcacuucacccccaagcugggcagcgugcagcugagcaccgacaccagcaacgacuucgagaccggccagaacaccagauucacccccgugggcguggugcaggacggcagcaccacccaccagaacgagccccagcagugggugcugcccgacuacagcggcagagacagccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggagagcgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagagcccuguga

SEQ ID NO: 22537 - RNA, 1623 nt, Artificial Sequence
  derived and/or modified sequence opt4 from VP1__Norovirus__ADR78914
augaagauggccagcaacgacgccacccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccagaacuacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcgugcacuucacccccaagcugggcagcgugcaguucagcaccgacaccagcaacgacuucgagaccggccagaacaccagauucacccccgugggcguggugcaggacggcagcaccacccaccagaacgagccccagcagugggugcugcccgacuacagcggcagagacagccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggagagcgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagagcccuguga

SEQ ID NO: 22538 - RNA, 1623 nt, Artificial Sequence
  derived and/or modified sequence opt4 from VP1__Norovirus__ADR78917
augaagauggccagcaacgacgccacccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccagaacuacaccaugaaccuggccagccagaacuggaacaacuacgaccccaccgaggagauccccgccccccugggcacccccgacuucgugggcagaauccagggcgugcugacccagaccaccagaagagacggcagcaccagaggccacaaggccaccgugagcaccggcagcgugcacuucacccccaagcugggcagcgugcaguucagcaccgacaccagcaacgacuucgagaccggccagaacaccagauucacccccgugggcguggugcaggacggcagcaccacccaccagaacgagccccagcagugggugcugcccgacuacagcggcagagacagccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggagagcgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagagcccuguga

SEQ ID NO: 22539 - RNA, 1623 nt, Artificial Sequence
  derived and/or modified sequence opt4 from VP1__Norovirus__ADR78920
augaagauggccagcaacgacgccacccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccagaacuacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcgugcacuucacccccaagcugggcagcgugcaguucagcaccgacaccagcaacgacuucgagaccggccagaacaccagauucacccccgugggcguggugcaggacggcgacaccacccaccagaacgagccccagcagugggugcugcccgacuacagcggcagagacagccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggagagcgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagagcccuguga

SEQ ID NO: 22540 - RNA, 1623 nt, Artificial Sequence
  derived and/or modified sequence opt4 from VP1__Norovirus__ADR78923
augaagauggccagcaacgacgccacccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccagaacuacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcgugcacuucacccccaagcugggcagcgugcaguucagcaccgacaccagcaacgacuucgagaccggccagaacaccagauucacccccgugggcguggugcaggacggcagcaccacccaccagaacgagccccagcagugggugcugcccgacuacagcggcagagacagccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggagagcgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagagcccuguga

SEQ ID NO: 22541 - RNA, 1623 nt, Artificial Sequence
  derived and/or modified sequence opt4 from VP1__Norovirus__ADR78929
augaagauggccagcaacgacgccagccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcaccagaaccuacagaaugaaccuggccagccagaacuggaacaacuacgaccccaccgaggagauccccgccccccugggcacccccgacuucgugggcaagauccagggcaugcugacccagaccaccaagggcgacggcagcaccagaggccacaaggccaccgugagcaccggcagcguggacuucacccccaagcugggcagcgugcaguucgccaccgacaccgacaacgacuucgagaccggccagaacaccagauucacccccgugggcgugauccaggacggcagcagcgcccacagaaacgagccccagcagugggugcugcccgacuacagcggcagaaccgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccagccagagcgacguggcccugcugagauucgugaaccccgacaccggcagagugcuguucgagugcaagcugcacaaggccggcuacgugaccguggcccacaccggccagcacgaccuggugaucccccccaacggcuacuucagauucgacagcugggugaaccaguucuacacccuggcccccaugggcaacggcgccggcagaagaagagcccuguga

SEQ ID NO: 22542 - RNA, 1623 nt, Artificial Sequence
  derived and/or modified sequence opt4 from VP1__Norovirus__ADR78932
augaagauggccagcagcgacgccagccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacagaaugaaccuggccagccagaacuggaacaacuacgaccccaccgaggagauccccgccccccugggcacccccgacuucgugggcaagauccagggcaugcugacccagaccaccaagggcgacggcagcaccagaggccacaaggccaccgugagcaccggcagcguggacuucacccccaagcugggcagcgugcaguucgccaccgacaccgacaacgacuucgagaccggccagaacaccagauucacccccgugggcgugauccaggacggcagcagcgcccacagaaacgagccccagcagugggugcugcccgacuacagcggcagaaccgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccagccagagcgacguggcccugcugagauucgugaaccccgacaccggcagagugcuguucgagugcaagcugcacaaggccggcuacgugaccguggcccacaccggccagcacgaccuggugaucccccccaacggcuacuucagauucgacagcugggugaaccaguucuacacccuggcccccaugggcaacggcgccggcagaagaagagcccuguga

SEQ ID NO: 22543 - RNA, 1623 nt, Artificial Sequence
  derived and/or modified sequence opt4 from VP1__Norovirus__ADR78938
augaagauggccagcaacgacgccagccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcaccagaagcuacagaaugaaccuggccagccagaacuggaacaacuacgaccccaccgaggagauccccgccccccugggcacccccgacuucgugggcaagauccagggcaugcugacccagaccaccaagagagacggcagcaccagaggccacaaggccaccgugagcaccggcagcguggacuucacccccaagcugggcagcgugcaguucgccaccgacaccgacaacgacuucgagaccggccagaacaccagauucacccccgugggcgugauccaggacggcagcagcacccacagaaacgagccccagcagugggugcugcccgacuacagcggcagaaccgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccagccagagcgacguggcccugcugagauucgugaaccccgacaccggcagagugcuguucgagugcaagcugcacaaggccggcuacgugaccguggcccacaccggccagcacgaccuggugaucccccccaacggcuacuucagauucgacagcugggugaaccaguucuacacccuggcccccaugggcaacggcgccggcagaagaagagcccuguga

SEQ ID NO: 22544 - RNA, 1623 nt, Artificial Sequence; identical to SEQ ID NO: 22385
  derived and/or modified sequence opt4 from VP1__Norovirus__ADR78941

SEQ ID NO: 22545 - RNA, 1623 nt, Artificial Sequence
  derived and/or modified sequence opt4 from VP1__Norovirus__ADR78944
augaagauggccagcaacgacgccagccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaccuacagaaugaaccuggccagccagaacuggaacaacuacgaccccaccgaggagauccccgccccccugggcacccccgacuucgugggcaagauccagggcaugcugacccagaccaccaagggcgacggcagcaccagaggccacaaggccaccgugagcaccggcagcguggacuucacccccaagcugggcagcgugcaguucgccaccgacaccgacaacgacuucgagaccggccagaacaccagauucacccccgugggcgugauccaggacggcagcagcacccacagaaacgagccccagcagugggugcugcccgacuacagcggcagaaccgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccagccagagcgacguggcccugcugagauucgugaaccccgacaccggcagagugcuguucgagugcaagcugcacaaggccggcuacgugaccguggcccacaccggccagcacgaccuggugaucccccccaacggcuacuucagauucgacagcugggugaaccaguucuacacccuggcccccaugggcaacggcgccggcagaagaagagcccuguga

SEQ ID NO: 22546 - RNA, 1623 nt, Artificial Sequence; identical to SEQ ID NO: 22385
  derived and/or modified sequence opt4 from VP1__Norovirus__ADR78947

SEQ ID NO: 22547 - RNA, 1623 nt, Artificial Sequence
  derived and/or modified sequence opt4 from VP1__Norovirus__ADR78950
augaagauggccagcaacgacgccagccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugcugcuggccggcaacgccuucaccgccggcaagaucaucuucgccgccgugccccccaccuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugguggccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagagacuguucaccggccccagcagcgccuucguggugcagccccagaacggcagaugcaccaccgacggcgugcugcugggcaccacccagcugagccccgugaacaucugcaccuucagaggcgacgugaccaacauccccggcagcagaaccuacagaaugaaccuggccagccagaacuggaacaacuacgaccccaccgaggagauccccgccccccugggcacccccgacuucgugggcaagauccagggcgugcugacccagaccaccaagggcgacggcagcaccagaggccacaaggccaccgugagaaccggcagcgccgacuucacccccaagcugggcagcgugcaguucgccaccgacaccgacaacgacuucgugaccggccagaacaccagauucacccccgugggcgugauccacgacggcagcagcgcccacagaaacgagccccagcagugggugcugcccgaguacagcggcagaagcgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccagccagagcgacguggcccugcugagauucgugaaccccgacaccggcagagugcuguucgagugcaagcugcacaaggccggcuacgugaccguggcccacaccggccagcacgaccuggugaucccccccaacggcuacuucagauucgacagcugggugaaccaguucuacacccuggcccccaugggcaacggcgccggcagaagaagagcccuguga

SEQ ID NO: 22548 - RNA, 1623 nt, Artificial Sequence
  derived and/or modified sequence opt4 from VP1__Norovirus__ADR78956
augaagauggccagcaacgacgccagccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcaccagaaccuacagaaugaaccuggccagccagaacuggaacaacuacgaccccaccgaggagauccccgccccccugggcacccccgacuucgugggcaagauccagggcaugcugacccagaccaccaagggcgacggcagcaccagaggccacaaggccaccgugagcaccggcagcguggacuucacccccaagcugggcagcgugcaguucgccaccgacaccgacaacgacuucgagaccggccagaacaccagauucacccccgugggcgugauccaggacggcagcagcgcccacagaaacgagccccagcagugggugcugcccgacuacagcggcagaaccgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagaccggcuacgugaccguggcccacaccggccagcacgaccuggugaucccccccaacggcuacuucagauucgacagcugggugaaccaguucuacacccuggcccccaugggcaacggcgccggcagaagaagagcccuguga

SEQ ID NO: 22549 - RNA, 1653 nt, Artificial Sequence
  derived and/or modified sequence opt4 from VP1__Norovirus__AEA02124
augaugauggccagcaaggacgccaccagcaacauggacggcaccagcggcgccggccagcuggugcccgagaacaacaacaccagcgagcccaucaacauggagcccguggccggcgccgugaccgccgccgccaccgccggccaggugaacaugaucgaccccuggaucaugaacaacuacgugcaggccccccagggcgaguucaccaucagccccaacaacacccccggcgacauccuguucgaccugcagcugggcccccaccugaaccccuuccuggcccaccugagccagauguacaacggcugggugggcaacaugaaggugagaguggugcuggccggcaacgccuucagcgccggcaagaucaucgugugcugcaucccccccggcuucagcgcccccaacaucagcaucgcccaggccaccauguucccccacgugaucgccgacgugagagugcuggagcccaucgacaucccccuggacgacgugagaaacgugcuguuccacaccaacgacaacggcaaccagaccaugagacugcugugcaugcuguacaccccccugagaagcggcggcaccagcagcggcaccgaccccuucgugaucgccggcagagugcugaccugccccacccccgacuucaacuuccuguuccuggugccccccaccguggagcagaagaccaagcaguucagcgugcccaaccugccccugaacgugaugagcaacagcagagugcccagccugcugaacgccaugguggugagccccgaccaggcccagguggugcaguuccagaacggcagaugcacccuggacggccagaugcugggcaccaccaccgugagcgccagcugcguggccagauucagaggcaagaccuuccaggcccccgacaacagacugggcaucaaccuggccgagaucagcggcgagcccuaccacgccuucgagagccccgccccccugggcuuccccgacuucggcgacggcgacuggcacgugaccgccaccaaggugacccccagccagcuggaggccaacgaccccgugguggugggcaacgugcagcccuacaacccccaguucgccccccaccugggcacccuggugguggagaaccccacccccgaccagguggccaccggcaccgaccugcuguucaacaucaccuggcugagcaacagagccaacaacagauucaaccccugggugauccccaacuacggcagcacccugaccgaggccgcccagcuggcccccagcaucuucccccccggcuucggcgagaccaucguguacuucaacagcaccuuccccgccgugggcgccaccacccacgccgccauccccugccugcugccccaggaguucguggcccacuucgugaacgagcaggcccccaucagaggcgaggccgcccugcugcacuacaucgaccccgacacccacagaaaccugggcgaguucaagaucuaccccgagggcuucgugaccugcgugcccaacgugggcggcaccggcccccagagccugcccaccaacggcguguucguguucgugagcugggugagcagauacuaccagcugaagcccgugggcaccgccggccaggccagaagacugggcuucagaagaguguga

SEQ ID NO: 22550 - RNA, 1647 nt, Artificial Sequence
  derived and/or modified sequence opt4 from VP1__Norovirus__AED02033
augaagauggccagcaacgacgccgcccccagcaacgacggcgccgccggccuggugcccgagaucaacaacgaggccauggcccuggagcccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgccuucaccgccggcaaggugaucuucgccgccaucccccccaacuuccccaucgacaaccugagcgccgcccagaucaccaugugcccccacgugaucguggacgugagacagcuggagcccaucaaccugcccaugcccgacgugagaaacaacuucuuccacuacaaccagggcagcgacagcagacugagacugaucgccaugcuguacaccccccugagagccaacaacagcggcgacgacguguucaccgugagcugcagagugcugaccagacccagccccgacuucagcuucaacuuccuggugccccccaccguggagagcaagaccaagcccuucacccugcccauccugaccaucagcgagaugagcaacagcagauuccccgugcccaucgacagccugcacaccagccccaccgagaacaucguggugcagugccagaacggcagagugacccuggacggcgagcugaugggcaccacccagcugcugcccagccagaucugcgccuucagaggcacccugaucagaagcaccagcagagccagcgaccaggccgacaccagcacccccagacuguucaacuacuacuggcacauccagcuggacaaccugaacggcacccccuacgaccccgccgaggacauccccgccccccugggcacccccgacuucagaggcaagguguucggcguggccagccagagaaaccccgacagcaccaccagagcccacgaggccaagguggacaccaccagcggcagauucacccccaagcugggcagccuggagaucaucaccgagagcgacgacuucgaccugaaccagagcaccaaguucacccccgugggcaucggcguggacaacgaggccgaguuccagcaguggagccugcccaacuacagcggccaguucacccacaacaugaaccuggcccccgccguggcccccaacuuccccggcgagcagcugcuguucuucagaagccagcugcccagcagcggcggcagaagcaacggcgugcuggacugccuggugccccaggagugggugcagcacuucuaccaggagagcgcccccgcccagacccagguggcccuggugagauacgugaaccccgacaccggcagagugcuguucgaggccaagcugcacaagcugggcuucaugaccaucgccaagaacggcgacagccccaucaccgugccccccaacggcuacuucagauucgagagcugggugaaccccuucuacacccuggcccccaugggcaccggcaacggcagaagaagaauccaguga

SEQ ID NO: 22551 - RNA, 1647 nt, Artificial Sequence
  derived and/or modified sequence opt4 from VP1__Norovirus__AED02034
augaagauggccagcaacgacgccgcccccagcaacgacggcgccgccggccuggugcccgagaucaacaacgaggccauggcccuggagcccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgccuucaccgccggcaaggugaucuucgccgccaucccccccaacuuccccaucgacaaccugagcgccgcccagaucaccaugugcccccacgugaucguggacgugagacagcuggagcccaucaaccugcccaugcccgacgugagaaacaacuucuuccacuacaaccagggcagcgacagcagacugagacugaucgccaugcuguacaccccccugagagccaacaacagcggcgacgacguguucaccgugagcugcagagugcugaccagacccagccccgacuucagcuucaacuuccuggugccccccaccguggagagcaagaccaagcccuucacccugcccauccugaccaucagcgagaugagcaacagcagauuccccgugcccaucgacagccugcacaccagccugaccgagaacaucguggugcagugccagaacggcagagugacccuggacggcgagcugaugggcaccacccagcugcugcccagccagaucugcgccuucagaggcacccugaccagaagcaccagcagagccagcgaccaggccgacaccgccacccccagacuguucaacuacuacuggcacauccagcugaacaaccugaacggcacccccuacgaccccgccgaggacauccccgccccccugggcacccccgacuucagaggcaagguguucggcguggccagccagagaaaccccgacagcaccaccagagcccacgaggccaagguggacaccaccagcggcagauucgcccccaagcugggcagccuggagaucagcaccgagaccgacgacuucaaccagaaccagcccaccagauucacccccgugggcaucggcguggacaacgaggccgacuuccagcaguggagccugcccgacuacagcggccaguucacccacaacaugaaccuggcccccgccguggcccccaacuuccccggcgagcagcugcuguucuucagaagccagcugcccagcagcggcggcagaagcagcggcauccuggacugccuggugccccaggagugggugcagcacuucuaccaggagagcgcccccgcccagacccagguggcccuggugagauacgugaaccccgacaccggcagagugcuguucgaggccaagcugcacaagcugggcuucaugaccaucgccaagaacggcgacagccccaucaccgugccccccaacggcuacuucagauucgagagcugggugaaccccuucuacacccuggcccccaugggcaccggcaacggcagaagaagaauccaguga

SEQ ID NO: 22552 - RNA, 1647 nt, Artificial Sequence
  derived and/or modified sequence opt4 from VP1__Norovirus__AED02035
augaagauggccagcaacgacgccgcccccagcaacgacggcgccgccggccuggugcccgagaucaacaacgaggccauggcccuggagcccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgccuucaccgccggcaaggugaucuucgccgccaucccccccaacuuccccaucgacaaccugagcgccgcccagaucaccaugugcccccacgugaucguggacgugagacagcuggagcccaucaaccugcccaugcccgacgugagaaacaacuucuuccacuacaaccagggcagcgacagcagacugagacugaucgccaugcuguacaccccccugagagccaacaacagcggcgacgacguguucaccgugagcugcagagugcugaccagacccagccccgacuucagcuucaacuuccuggugccccccaccguggagagcaagaccaagcccuucacccugcccauccugaccaucagcgagaugagcaacagcagauuccccgugcccaucgacagccugcacaccagccccaccgagaacaucguggugcagugccagaacggcagagugacccuggacggcgagcugaugggcaccacccagcugcugcccagccagaucugcgccuucagaggcacccugaccagaagcaccagcagaaccggcgaccaggccgacaccgccagccccagacuguucaacuacuacuggcacauccagcuggacaaccugaacggcacccccuacgaccccgccgaggacauccccgccccccugggcacccccgacuucagaggcaagguguucggcguggccagccagagaaaccccgacagcaccaccagagcccacgaggccaagguggacaccaccagcggcagauucgcccccaagcugggcagccuggagaucagcaccgagagcgacgacuucgacagcaaccagcccaccagauucacccccgugggcaucggcguggacagagagaccgacuuccagcaguggacccugcccgaguacagcggccaguucacccacaacaugaaccuggcccccgccguggcccccaacuuccccggcgagcagcugcuguucuucagaagccagcugcccagcagcggcggcagaagcggcggcauccuggacugccuggugccccaggagugggugcagcacuucuaccaggagagcgcccccgcccagacccagguggcccuggugagauacgugaaccccgacaccggcagagugcuguucgaggccaagcugcacaagcugggcuucaugaccaucgccaagaacggcgacagccccaucaccgugccccccaacggcuacuucagauucgagagcugggugaaccccuucuacacccuggcccccaugggcaccggcaacggcagaagaagaauccaguga

SEQ ID NO: 22553 - RNA, 1647 nt, Artificial Sequence
  derived and/or modified sequence opt4 from VP1__Norovirus__AED02037
augaagauggccagcaacgacgccgcccccagcaacgacggcgccgccggccuggugcccgagaucaacaacgaggccauggcccuggaccccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgccuucaccgccggcaaggugaucuucgccgccaucccccccaacuuccccaucgacaaccugagcgccgcccagaucaccaugugcccccacgugaucguggacgugagacagcuggagcccaucaaccugcccaugcccgacgugagaaacaacuucuuccacuacaaccagggcagcgacagcagacugagacugaucgccaugcuguacaccccccugagagccaacaacagcggcgacgacguguucaccgugagcugcagagugcugaccagacccagccccgacuucagcuucaacuuccuggugccccccaccguggagagcaagaccaagcccuucacccugcccauccugaccaucagcgagaugagcaacagcagauuccccgugcccaucgacagccugcacaccagccccaccgagagcaucguggugcagugccagaacggcagagugacccuggacggcgagcugaugggcaccacccagcugcugcccaaccagaucugcgccuucagaggcacccugaccagaagcaccaacagagccagcgaccaggccgacaccgccacccccagacuguucaaccaccacuggcacauccagcuggacaaccugaacggcacccccuacgaccccgccgaggacauccccgccccccugggcacccccgacuucagaggcaagguguucggcguggccagccagagaaaccccgacagcaccaccagagcccacgaggccaagguggacaccaccagcggcagauucacccccaagcugggcagccuggagaucaccaccgagagcgacgacuucgaccccaaccagagcaccaaguucacccccgugggcaucggcguggacaacgaggccgacuuccagcaguggagccugcccgacuacagcggccaguucacccacaacaugaaccuggcccccgccguggcccccaacuuccccggcgagcagcugcuguucuucagaagccagcugcccagcagcggcggcagaagcaacggcauccuggacugccuggugccccaggagugggugcagcacuucuaccaggagagcgcccccgcccagacccagguggcccuggugagauacgugaaccccgacaccggcagagugcuguucgaggccaagcugcacaagcugggcuucaugaccaucgccaagaacggcgacagccccaucaccgugccccccaacggcuacuucagauucgagagcugggugaaccccuucuacacccuggcccccaugggcaccggcaacggcagaagaagaauccaguga

SEQ ID NO: 22554 - RNA, 1647 nt, Artificial Sequence
  derived and/or modified sequence opt4 from VP1__Norovirus__AED02038
augaagauggccagcaacgacgccgcccccagcaacgacggcgccgccggccuggugcccgagaucaacaacgaggccauggcccuggagcccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgccuucaccgccggcaaggugaucuucgccgccaucccccccaacuuccccaucgacaaccugagcgccgcccagaucaccaugugcccccacgugaucguggacgugagacagcuggagcccaucaaccugcccaugcccgacgugagaaacaacuucuuccacuacaaccagggcagcgacagcagacugagacugaucgccaugcuguacaccccccugagagccaacaacagcggcgacgacguguucaccgugagcugcagagugcugaccagacccagccccgacuucagcuucaacuuccuggugccccccaccguggagagcaagaccaagcccuucacccugcccauccugaccaucagcgagaugagcaacagcagauuccccgugcccaucgacagccugcacaccagccccaccgagaacaucguggugcagugccagaacggcagagugacccuggacggcgagcugaugggcaccacccagcugcugcccagccagaucugcgccuucagaggcacccugaccagaagcaccagcagagccggcgaccaggccgacaccgccacccccagacuguucaacuacuacuggcacauccagcuggacaaccugaacggcacccccuacgaccccgccgaggacauccccgccccccugggcacccccgacuucagaggcaagguguucggcguggccagccagagaaaccccgacagcaccaccagagcccacgaggccaagguggacaccaccagcggcagauucgcccccaagcugggcagccuggagaucagcaccgagagcagcgacuucgacagcaaccagcccaccagauucacccccgugggcaucggcguggacaacgaggccgacuuccagcaguggagccugcccgacuacagcggccaguucacccacaacaugaaccuggcccccgccguggcccccaacuuccccggcgagcagcugcuguucuucagaagccagcugcccagcagcggcggcagaagcaacggcauccuggacugccuggugccccaggagugggugcagcacuucuaccaggagagcgcccccgcccagacccagguggcccuggugagauacgugaaccccgacaccggcagagugcuguucgaggccaagcugcacaagcugggcuucaugaccaucgccaagaacggcgacagccccaucaccgugccccccaacggcuacuucagauucgagagcugggugaaccccuucuacacccuggcccccaugggcaccggcaacggcagaagaagaauccaguga

SEQ ID NO: 22555 - RNA, 1647 nt, Artificial Sequence
  derived and/or modified sequence opt4 from VP1__Norovirus__AED02039
augaagauggccagcaacgacgccgcccccagcaacgacggcgccgccggccuggugcccgagaucaacaacgaggccauggcccuggagcccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgccuucaccgccggcaaggugaucuucgccgccaucccccccaacuuccccaucgacaaccugagcgccgcccagaucaccaugugcccccacgugaucguggacgugagacagcuggagcccaucaaccugcccaugcccgacgugagaaacaacuucuuccacuacaaccagggcagcgacagcagacugagacugaucgccaugcuguacaccccccugagagccaacaacagcggcgacgacguguucaccgugagcugcagagugcugaccagacccagccccgacuucagcuucaacuuccuggugccccccaccguggagagcaagaccaagcccuucacccugcccauccugaccaucagcgagaugagcaacagcagauuccccgugcccaucgacagccugcacaccagccccaccgagaacaucguggugcagugccagaacggcagagugacccuggacggcgagcugaugggcaccacccagcugcugcccagccagaucugcgccuucagaggcacccugaccagaagcaccagcagagccggcgaccaggccgacaccgccacccccagacuguucaacuacuacuggcacauccagcuggacaaccugaacggcacccccuacgaccccgccgaggacauccccgccccccugggcacccccgacuucagaggcaagguguucggcguggccagccagagaaaccccgacagcaccaccagagcccacgaggccaagguggacaccaccagcggcagauucgcccccaagcugggcagccuggagaucagcaccgagagcagcgacuucgacagcaaccagcccaccagauucacccccgugggcaucggcguggacaacgaggccgacuuccagcaguggagccugcccgacuacagcggccaguucacccacaacaugaaccuggcccccgccguggcccccaacuuccccggcgagcagcugcuguucuucagaagccagcugcccagcagcggcggcagaagccacggcauccuggacugccuggugccccaggagugggugcagcacuucuaccaggagagcgcccccgcccagacccagguggcccuggugagauacgugaaccccgacaccggcagagugcuguucgaggccaagcugcacaagcugggcuucaugaccaucgccaagaacggcgacagccccaucaccgugccccccaacggcuacuucagauucgagagcugggugaaccccuucuacacccuggcccccaugggcaccggcaacaagagaagaagaauccaguga

SEQ ID NO: 22556 - RNA, 1623 nt, Artificial Sequence
  derived and/or modified sequence opt4 from VP1__Norovirus__AEG79290
augaagauggccagcaacgacgccaaccccagcgacggcagcgccgccaaccuggugcccgaggugaacaacgaggugauggcccuggagcccguggccggcgccgcccuggccgcccccguggccggccagcagaacgugaucgaccccuggaucagaaacaacuucgugcaggcccccggcggcgaguucaccgugagccccagaaacgcccccggcgagauccuguggagcgccccccugagccccgaccugaaccccuaccugagccaccuggccagaauguacaacagcuacgccggcggcuucgaggugcaggugauccuggccggcaacgccuucaccgccggcaagaucaucuucgccgccgugccccccaacuuccccaucgagggccugagccccagccaggugaccauguucccccacaucaucguggacgugagacagcuggagcccgugcugaucccccugcccgacgugagaaacaacuucuaccacuacaaccagagcaacgagcccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcagcuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagcaucaacuggaacaacuacgaccccaccgaggagauccccgccccccugggcacccccgacuucgugggcaagauccagggcaugcugacccagaccaccagaggcgacggcagcaccagaggccacagagccaccguguacaccggcagcgcccccuucacccccaagcugggcagcgugcaguucaccaccgacaccgacaacgacuucgagaccaaccagaacaccaaguucacccccgugggcguggugcaggacggcgacaccgcccacagaaacgagccccagcagugggugcugcccagcuacagcggcagaaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22557 - RNA, 1608 nt, Artificial Sequence
  derived and/or modified sequence opt4 from VP1__Norovirus__AEI29586
augaagauggccagcaacgacgccgcccccagcaacgacggcgccgccggccuggugcccgaggugaacaacgagaccauggcccuggagcccguggccggcgccagcaucgccgccccccugaccggccagaacaacgugaucgaccccuggaucagacugaacuucgugcaggcccccaacggcgaguucaccgugagccccagaaacagccccggcgaggugcugcugaaccuggagcugggccccgagcugaaccccuaccuggcccaccugagcagaauguacaacggcuacgccggcggcguggaggugcaggugcugcuggccggcaacgccuucaccgccggcaagcugguguucgccgccgugcccccccacuucccccuggagaacaucagccccggccagaucaccauguucccccacgugaucaucgacgugagaacccuggagcccgugcugcugccccugcccgacgugagaaacaacuucuuccacuacaaccagcagaacgagcccagaaugagacugguggccaugcuguacaccccccugagaagcaacggcagcggcgacgacguguucaccgugagcugcagagugcugaccagacccagccccgacuucgacuucaacuaccuggugccccccaccguggagagcaagaccaagcccuucacccugcccauccugaccaucggcgagcugaccaacagcagauuccccgugcccaucgacgagcuguacaccagccccaacgagagccugguggugcagccccagaacggcagaugcgcccuggacggcgagcugcagggcaccacccagcugcugcccaccgccaucugcagcuucagaggcagaaucaaccagaaggugagcggcgagaaccacguguggaacaugcaggugaccaacaucgacggcacccccuucgaccccaccgaggacgugcccgccccccugggcacccccgacuucagcggcaagcuguucggcgugcugagccagagagaccacgacaacgccugcagaagccacgacgccgugaucgccaccaacagcgccaaguucacccccaagcugggcgccauccagaucggcaccugggagcaggacgacgugcacaucaaccagcccaccaaguucacccccgugggccuguucgagagcgagggcuucaaccaguggacccugcccaacuacagcggcgcccugacccugaacaugggccuggccccccccguggcccccaccuuccccggcgagcagauccuguucuucagaagccacaucccccugaagggcggcguggccgaccccgugaucgacugccugcugccccaggaguggauccagcaccuguaccaggagagcgcccccagccagaccgacguggcccugaucagauucaccaaccccgacaccggcagagugcuguucgaggccaagcugcacagaagcggcuacaucaccguggccaacaccggcagcagacccaucguggugcccgccaacggcuacuucagauucgacagcugggugaaccaguucuacagccuggcccccaugggcaccggcaacggcagaagaagagugcaguga

SEQ ID NO: 22558 - RNA, 1623 nt, Artificial Sequence
  derived and/or modified sequence opt4 from VP1__Norovirus__AEJ82646
augaagauggccagcaacgacgccacccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacguguucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggccccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccagaacuacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcgugcacuucacccccaagcugggcagcauccaguucagcaccgacaccagcaacgacuucgagaccggccagaacaccagauucacccccgugggcguggugcaggacggcagcaccacccaccagaacgagccccagcagugggugcugcccgacuacagcggcagagacagccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggagagcgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagagcccuguga

SEQ ID NO: 22559 - RNA, 1623 nt, Artificial Sequence
  derived and/or modified sequence opt4 from VP1__Norovirus__AER11308
augaagauggccagcaacgacgccacccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccagaacuacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcgugcacuucacccccaagcugggcagcgugcaguucagcaccgacaccagcaacgacuucgagaccggccagaacaccagauucacccccgugggcguggugcaggacggcagcaccacccaccagaacgagccccagcagugggugcugcccaacuacagcggcagagacagccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggagagcgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagagcccuguga

SEQ ID NO: 22560 - RNA, 1623 nt, Artificial Sequence
  derived and/or modified sequence opt4 from VP1__Norovirus__AER11310
augaagauggccagcaacgacgccacccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccagaacuacaccgugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcgugcacuucacccccaagcugggcagcgugcaguucagcaccgacaccagcaacgacuucgagaccggccagaacaccagauucacccccgugggcguggugcaggacggcagcaccacccaccagaacgagccccagcagugggugcugcccaacuacagcggcagagacagccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggagagcgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagagcccuguga

SEQ ID NO: 22561 - RNA, 1623 nt, Artificial Sequence
  derived and/or modified sequence opt4 from VP1__Norovirus__AER11312
augaagaucgccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacagcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccagcacccaggaguacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcgugcacuucacccccaagcugggcagaauccaguucagcaccgacaccagcaacgacuucgagaccggccagaacaccagauucacccccgugggcguggugcaggacggcagcaccacccaccagaacgagccccagcagugggugcugcccaacuacagcggcagagacagccacaacgugcaccuggcccccgccguggcccccagcuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22562 - RNA, 1623 nt, Artificial Sequence
  derived and/or modified sequence opt4 from VP1__Norovirus__AER11314
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcaccagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugaugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22563 - RNA, 1623 nt, Artificial Sequence; identical to SEQ ID NO: 22522
  derived and/or modified sequence opt4 from VP1__Norovirus__AER11316

SEQ ID NO: 22564 - RNA, 1623 nt, Artificial Sequence; identical to SEQ ID NO: 22522
  derived and/or modified sequence opt4 from VP1__Norovirus__AER11318

SEQ ID NO: 22565 - RNA, 1623 nt, Artificial Sequence
  derived and/or modified sequence opt4 from VP1__Norovirus__AER11320
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22566 - RNA, 1623 nt, Artificial Sequence; identical to SEQ ID NO: 22522
  derived and/or modified sequence opt4 from VP1__Norovirus__AER11324

SEQ ID NO: 22567 - RNA, 1623 nt, Artificial Sequence
  derived and/or modified sequence opt4 from VP1__Norovirus__AER11326
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuaccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcggcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22568 - RNA, 1623 nt, Artificial Sequence; identical to SEQ ID NO: 22535
  derived and/or modified sequence opt4 from VP1__Norovirus__AER11328

SEQ ID NO: 22569 - RNA, 1623 nt, Artificial Sequence
  derived and/or modified sequence opt4 from VP1__Norovirus__AER11330
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagacccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22570 - RNA, 1623 nt, Artificial Sequence; identical to SEQ ID NO: 22070
  derived and/or modified sequence opt4 from VP1__Norovirus__AER11332

SEQ ID NO: 22571 - RNA, 1623 nt, Artificial Sequence; identical to SEQ ID NO: 22535
  derived and/or modified sequence opt4 from VP1__Norovirus__AER11334

SEQ ID NO: 22572 - RNA, 1623 nt, Artificial Sequence
  derived and/or modified sequence opt4 from VP1__Norovirus__AER11336
augaagauggccagcaacgacgccagccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccgcccugaacuggaacaacuacgaccccaccgaggagauccccgccccccugggcacccccgacuucgugggcaagauccagggcgugcugacccagaccaccaaggccgacggcagcaccagaggccacaaggccaccguguacaccggcagcgccgacuucacccccaagcugggcagcgugcaguucaacaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22573 - RNA, 1623 nt, Artificial Sequence
  derived and/or modified sequence opt4 from VP1__Norovirus__AER11340
augaagauggccagcaacgacgccagccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccgcccugaacuggaacaacuacgaccccaccgaggagauccccgccccccugggcacccccgacuucgugggcaagauccagggcgugcugacccagaccaccaaggccgacggcagcaccagaggccacaaggccaccguguacaccggcagcgccgacuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22574 - RNA, 1623 nt, Artificial Sequence; identical to SEQ ID NO: 22573
  derived and/or modified sequence opt4 from VP1__Norovirus__AER11342

SEQ ID NO: 22575 - RNA, 1623 nt, Artificial Sequence
  derived and/or modified sequence opt4 from VP1__Norovirus__AER11344
augaagauggccagcaacgacgccagccccagcgacggcagcgccgccaaccuggugcccgaggugaacaacgaggugauggcccuggagcccguggugggcgccgccaucgccgcccccguggccggccagaagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccgcccugaacuggaacaacuacgaccccaccgaggagauccccgccccccugggcacccccgacuucgugggcaagauccagggcgugcugacccagaccaccaaggccgacggcagcaccagaggccacaaggccaccguguacaccggcagcgccgacuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22576 - RNA, 1623 nt, Artificial Sequence; identical to SEQ ID NO: 22573
  derived and/or modified sequence opt4 from VP1__Norovirus__AER11346

SEQ ID NO: 22577 - RNA, 1623 nt, Artificial Sequence
  derived and/or modified sequence opt4 from VP1__Norovirus__AER11348
augaagauggccagcaacgacgccagccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagcagcagccaggugaccauguucccccacaucaucguggacgugagacagcuggagcccgugcugaucccccugcccgacgugagaaacaacuucuaccacuacaaccagagcagcgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccgcccugaacuggaacaacuacgaccccaccgaggagauccccgccccccugggcacccccgacuucgugggcaagauccagggcgugcugacccagaccaccaaggccgacggcagcaccagaggccacaaggccaccguguacaccggcagcgccgacuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22578 - RNA, 1623 nt, Artificial Sequence
  derived and/or modified sequence opt4 from VP1__Norovirus__AER11350
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaagcaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcguguuccugggcaccacccagcugagccccgugaacaucugcaccuucagaggcgacgugacccacaucaccggcagcagaaacuacaccaugaaccuggccacccagaacuggaacagcuacgaccccaccgaggagauccccgccccccugggcacccccgacuucgugggcaagauccagggcgugcugacccagaccaccagagccgacggcagcaccagaggccacaaggccaccguguacaccggcagcgccgacuucgcccccaagcugggcagagugcaguucgccaccgacaccgacaacgacuucgacgccaaccagaacaccaaguucacccccgugggcgugauccaggacggcgacaccgcccacagaaacgagccccagcagugggugcugcccagcuacagcggcagaaacagccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22579 - RNA, 1623 nt, Artificial Sequence
  derived and/or modified sequence opt4 from VP1__Norovirus__AER11352
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccacccagaacuggaacagcuacgaccccaccgaggagauccccgccccccugggcacccccgacuucgugggcaagauccagggcgugcugacccagaccaccagagccgacggcagcaccagaggccacaaggccaccguguacaccggcagcgccgacuucgcccccaagcugggcagagugcaguucgccaccgacaccgacaacgacuucgacgccaaccagaacaccaaguucacccccgugggcgugauccaggacggcggcaccgcccacagaaacgagccccagcagugggugcugcccagcuacagcggcagaaacagccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22580 - RNA, 1623 nt, Artificial Sequence
  derived and/or modified sequence opt4 from VP1__Norovirus__AER11354
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgccgacuucacccccaagcugggcagcgugcaguucgccaccgacaccgagaacgacuucgagacccaccagaacaccaaguucacccccgugggcgugauccaggacggcagcaccacccacagaaacgagccccagcagugggugccccccagcuacagcggcagaaacgugcacaacgugcaccuggcccccgccguggcccccaacuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22581 - RNA, 1623 nt, Artificial Sequence
  derived and/or modified sequence opt4 from VP1__Norovirus__AER11356
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgccgacuucacccccaagcugggcagcgugcaguucgccaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaacuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22582 - RNA, 1623 nt, Artificial Sequence; identical to SEQ ID NO: 22072
  derived and/or modified sequence opt4 from VP1__Norovirus__AER11358

SEQ ID NO: 22583 - RNA, 1623 nt, Artificial Sequence
  derived and/or modified sequence opt4 from VP1__Norovirus__AER11360
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccaccugaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22584 - RNA, 1647 nt, Artificial Sequence
  derived and/or modified sequence opt4 from VP1__Norovirus__AEX10549
augaagauggccagcaacgacgccgcccccagcaacgacggcgccgccggccuggugcccgagaucaacaacgaggccauggcccuggagcccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgccuucaccgccggcaaggugaucuucgccgccaucccccccaacuuccccaccgacaaccugagcgccgcccagaucaccaugugcccccacgugaucguggacgugagacagcuggagcccaucaaccugcccaugcccgacgugagaaacaacuucuuccacuacaaccagggcagcgacagcagacugagacugguggccaugcuguacaccccccugagagccaacaacagcggcgacgacguguucaccgugagcugcagagugcugaccagacccagccccgacuucagcuucaacuuccuggugccccccaccguggagagcaagaccaagcccuucacccugcccauccugaccaucagcgagaugagcaacagcagauuccccgugcccaucgacagccugcacaccagccccaccgacaacaucguggugcagugccagaacggcagagugacccuggacggcgagcugaugggcaccacccagcugcugcccagccagaucugcgccuucagaggcgugcugaccagaagcaccagcagagccagcgaccaggccgacaccgccacccccagacuguucaacuaccacuggcacauccagcuggacaaccugaacggcacccccuacgaccccgccgaggacauccccgccccccugggcacccccgacuucagaggcaagguguucggcguggccagccagagaaaccccgacagcaccaccagagcccacgaggccaagguggacaccaccagcggcagauucacccccaagcugggcagccuggagaucagcaccgagagcggcgacuucgaccagaaccagcccaccagauucacccccgugggcaucggcguggacaacgaggccgacuuccagcaguggacccugcccgacuacagcggccaguucacccacaacaugaaccuggcccccgccguggcccccaacuuccccggcgagcagcugcuguucuucagaagccaccugcccagcagcggcggcagaagcaacggcauccuggacugccuggugccccaggagugggugcagcacuucuaccaggagagcgcccccgcccagacccagguggcccuggugagauacgugaaccccgacaccggcagagugcuguucgaggccaagcugcacaagcugggcuucaugaccaucgccaagagcggcgacagccccaucaccgugccccccaacggcuacuucagauucgagagcugggugaaccccuucuacacccuggcccccaugggcaccggcaacggcagaagaagaauccaguga

SEQ ID NO: 22585 - RNA, 1623 nt, Artificial Sequence
  derived and/or modified sequence opt4 from VP1__Norovirus__AEX91910
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagacccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22586 - RNA, 1737 nt, Artificial Sequence
  derived and/or modified sequence opt4 from VP1__Norovirus__AFD30970
augaagauggccagcagcgacgccacccccagcagcgacggcgccggcaaccuggugcccgagagccagcaggaggugcugccccuggcccccguggccggcgccgcccuggccgcccccguggugggccagcagaacaucaucgaccccuggaucaaggagaacuucgugcaggccccccagggcgaguucaccgugagccccaagaacagccccggcgaggugcuggugaaccuggagcugagccccagacugaaccccuaccuggaccaccugagcaagauguacaacgccuacgccggcggcauggagguggagaucauccuggccggcaacgccuucaccgccggcaaggugcugaucgccgccgugccccccaacuuccccaucgagaacaucagcgccagccaggccagccaguucccccacgugaucguggacgugagaacccuggagcccaucagacugccccugcccgacgugagaaccaacuucuuccacuacaccacccaggaggagcccagaaugagaaucguggccuggcuguacaccccccugagaaccaacggcagcggcgacgacagcuucaccgugagcggcagaauccugaccagacccagccccgacuucgaguucagcuuccuggugccccccaccguggagaccaagaccgugagcuucagcgugcccggccuggugguggaggacaugagcaacagcagauggcccgcccagaucaacggccugguggugagaggcaacgaggcccagguggugcacuuccagaacggcagaugcaccaccgagggcacccugcugggcaccaccacccugagcaucaacagcaucugcggccugagaggccugagcgugagccaggccagcgugagaggcgcccccgcccugaccgaggagaugcccccccuggaggacgagguggccgacggcgccgccgccaccuacacccuggccagagccgccgacaccacccuguggcugagaguggaggagcccgacggcagacccuacgacaucuucggcgaccagcccgccccccugggcacccccgacuucaccgccgugaucgugggcaccgccaucagacccagaaccgccagcggcgccuaccugcacgacgccuacguggacaccacccccggcgacgccgacuucacccccagcaccggcaacaccaagaucgugcugagaggcggcggcagcggccacgugggccagggccacuacuggcaguucagacccaucgccguggagggcggcggcagcagaccccaguaccaggaguacaaccugcccgacuacgccggccccaccgccagcaaccacgaccuggccccccccguggcccccagaaugcccggcgagcugcugcugcuguucgagagcgacaugcccgugugggacaacggcgccggcgccgcccccgcccagaagauccacugccugcugcccaacgaguucaucacccaccuguucgaccugcaggcccccgcccuggccgaggccgcccugcugagauacgugcaccccgacagcggcagaacccuguucgagugcaagcuguacagagagggcuacauggugguggccgcccccgccggcagacugaacuucccccuggacggcuacuucagauucgacagcugggugagcgccuucuacauccugagccccgugggcagcggccagggcagaagaggcagaagcaaggccgccuga

SEQ ID NO: 22587 - RNA, 1623 nt, Artificial Sequence
  derived and/or modified sequence opt4 from VP1__Norovirus__AFH88383
augaugauggccagcaaggacgcccccaccagccccgacggcgccagcggcgccggccagcuggugcccgaggccaacaccgccgagcagaucagcauggaccccguggccggcgccagcaccgccguggccaccgccggccaggugaacaugaucgaccccuggaucuucaacaacuucgugcaggccccccagggcgaguucaccaucagccccaacaacacccccggcgacauccuguucgaccugcagcugggcccccaccugaaccccuuccuggcccaccugagccagauguacaacggcugggugggcaacaugagagugagaauccugcuggccggcaacgccuucaccgccggcaagaucaucaucugcugcgugccccccggcuucgacgccagaauccugaccaucgcccaggccacccuguucccccaccugaucgccgacgugagaacccuggagcccguggagcugccccuggaggacgugagaaacgugcuguaccacaacagcagccagccccagcccaccaugagacugguggccaugcuguacaccccccugagaaccggcggcggcagcggcggcaccgacgccuucgugguggccggcagagugcugaccugccccgcccccgacuucagcuuccuguuccuggugccccccagcguggagcagaagaccagaguguucagcgugcccaacaucccccugaaggaccugagcaacagcagagugcccgugcccgugcagggcauguucaugagccccgacgugaaccagagcgugcaguuccagaacggcagaugccagaucgacggccagcugcagggcaccacccccgugagccugagccagcugugcaagaucagaggcaagaccagcagcaacgccagagugcugaaccugagcgagguggacggcacccccuucaucccccuggagagccccgcccccgugggcuuccccgaccugggcggcugcgacuggcacgugaacuucaccuuccaggcccagaaccaggaccccagccagagcgugaccuucgccaccaacgacgccagcuucgugcccuaccugggcagcaucagcccccacaacggcggcgacuuccacgccggcgacaucaucggcagccugggcuggaucagcgcccccagcgacaacagccagcugaacguguggaccauccccaaguacggcagcagccugcccgacgugacccaccuggcccccgccguguucccccccggcuucggcgaggugauccuguacuucuacagcaccuuccccggcagcggccagcccagccagcugcaggugcccugccugcugccccaggaguucaucacccacuucugcaacgagcaggcccccaucgccggcgaggccgcccugcugcacuacguggaccccgacaccggcagaaaccugggcgaguucaagcuguaccccgacggcuucaugaccugcgugcccaacagcgugagcagcggcccccagacccugcccaucaacggcguguucguguucgugagcugggugagcagauucuaccagcugaagcccgugggcaccgccagcgccgccagaagacugggccugagaagaaucuga

SEQ ID NO: 22588 - RNA, 1671 nt, Artificial Sequence
  derived and/or modified sequence opt4 from VP1__Norovirus__AFJ21376
augaagauggccagcagcgacgccgcccccagcaccgacggcgccggcaaccuggugcccgagagccagcaggaggugcugccccuggcccccguggccggcgccgcccuggccgcccccguggugggccagaccaacaucaucgaccccuggaucaaggagaacuucgugcaggccccccagggcgaguucaccgugagccccaagaacagccccggcgagauccuggugaaccuggagcugggccccaagcugaaccccuaccuggaccaccugagcagaauguacaacagcuacgccggcggcaucgacgugaugguggugcuggccggcaacgccuucaccgccggcaaggugcugaucgccgccaucccccccaacuuccccguggagggcgugagcgccagccaggccacccaguucccccacgugaucaucgacgugagaacccuggaccccgugagacugccccugcccgacgugagaagcaccuucuuccacuacaccaacgacaccgagcccaagaugagacuggugaucuggcuguacaccccccugagaaccaacggcagcggcgacgacagcuucaccgugagcggcagaauccugaccagacccagccaggacuucgaguucgccuuccugaucccccccaccguggagaccaagaccacccccuucagcgugcccggcuucagcgugcaggagaugagcaacagcagauggcccgccgccaucagcgccaugguggugagaggcaacgagccccagguggugcaguuccagaacggcagagcccaccuggacggcaugcugcugggcaccacccccgugagccccaacuacaucgccagcuacagaggcaucagcaccggcaacagcagaagcgccagcagcgaggccgacgagagagccgugggcagcuucgacgugugggugagacugcaggagcccgacggccagcccuacgacaucuucggcaagcagcccgcccccaucggcacccccgacuucaaggccgugaucgugggcuucgccgccagaccccugaccagcggcagcuacgccaacgaggccuacgugaacaccaccgccagcgacuacgcccccgccaccggcaacaugagauucaccgugagaaacggcggcaccggccacaucagcgccaacaaguacugggaguucaagagcuucggcguggagggcgagagacacaccgacauccaguaccaggaguacgagcugcccgacuacagcggccagguggccagcaaccacaaccuggccccccccguggcccccagaaugcccggcgagagccugcugcuguuccagagcaacaugcccgugugggacgacggccacggcgagagcacccccaagaagauccacugccugcugccccaggaguucaucggccacuucuucgacagacaggcccccagccugggcgacgccgcccugcugagauacgugaaccaggagaccaacagagugcuguucgagugcaagcuguacagagacggcuacaucaccguggccgccagcagcggccugcuggacuucccccuggacggcuucuucagauucgacagcugggugagcagcuucuacauccugagccccgugggcagcggccagggcagaagaggcagagugagauuccaguga

SEQ ID NO: 22589 - RNA, 1608 nt, Artificial Sequence
  derived and/or modified sequence opt4 from VP1__Norovirus__AFJ21379
augaagauggccagcagcgacgccgcccccagcaacgacggcgccgccggccuggugcccgaggugaacaacgagaccauggcccuggagcccguggccggcgccagcaucgccgccccccugaccggccagaacaacgugaucgaccccuggaucagacugaacuucgugcaggcccccaacggcgaguucaccgugagccccagaaacagccccggcgaggugcugcugaaccuggagcugggccccgagcugaaccccuaccuggcccaccugagcagaauguacaacggcuacgccggcggcguggaggugcaggugcugcuggccggcaacgccuucaccgccggcaagcugguguucgccgccgugcccccccacuucccccuggagaacaucagccccggccagaucaccauguucccccacgugaucaucgacgugagaacccuggagcccgugcugcugccccugcccgacgugagaaacaacuucuuccacuacaaccagcagaacgagcccagaaugagacugguggccaugcuguacaccccccugagaagcaacggcagcggcgacgacguguucaccgugagcugcagagugcugaccagacccagccccgacuucgacuucaacuaccuggugccccccaccguggagagcaagaccaagcccuucacccugcccauccugaccaugggcgagcugaccaacagcagauuccccgugcccaucgacgagcuguacaccagccccaacgagagccugguggugcagccccagaacggcagaugcgcccuggacggcgagcugcagggcaccacccagcugcugcccaccgccaucugcagcuucagaggcagaaucaaccagaaggugagcggcgacaaccacguguggaacaugcaggugaccaacaucaacggcacccccuucgaccccaccgaggacgugcccgccccccugggcacccccgacuucagcggcaagcuguucggcgugcugagccagagagaccacgacaacgccugcagaagccacgacgccgugaucgccaccaacagcgccaaguucacccccaagcugggcgccauccagaucggcaccugggagcaggacgacgugcacaucaaccagcccaccaaguucacccccgugggccuguucgagagcgagggcuucaaccaguggacccugcccaacuacagcggcgcccugacccugaacaugggccuggccccccccguggcccccaccuuccccggcgagcagauccuguucuucagaagccacaucccccugaagggcggcguggccgaccccgugaucgacugccugcugccccaggaguggauccagcaccuguaccaggagagcgcccccagccagaccgacguggcccugaucagauucaccaaccccgacaccggcagagugcuguucgaggccaagcugcacagaagcggcuacaucaccguggccaacaccggcagcagacccaucguggugcccgccaacggcuacuucagauucgacagcugggugaaccaguucuacagccuggcccccaugggcaccggcaacggcagaagaagagugcaguga

SEQ ID NO: 22590 - RNA, 1608 nt, Artificial Sequence; identical to SEQ ID NO: 22278
  derived and/or modified sequence opt4 from VP1__Norovirus__AFJ21382

SEQ ID NO: 22591 - RNA, 1623 nt, Artificial Sequence
  derived and/or modified sequence opt4 from VP1__Norovirus__AFJ21387
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccaucuacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22592 - RNA, 1623 nt, Artificial Sequence; identical to SEQ ID NO: 22512
  derived and/or modified sequence opt4 from VP1__Norovirus__AFJ21388

SEQ ID NO: 22593 - RNA, 1623 nt, Artificial Sequence; identical to SEQ ID NO: 22522
  derived and/or modified sequence opt4 from VP1__Norovirus__AFJ21389

SEQ ID NO: 22594 - RNA, 1623 nt, Artificial Sequence
  derived and/or modified sequence opt4 from VP1__Norovirus__AFJ21390
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacgccaugaaccuggccagccugaacuggaacaacuacgaccccaccgaggagauccccgccccccugggcacccccgacuucgugggcaagauccagggccugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22595 - RNA, 1623 nt, Artificial Sequence
  derived and/or modified sequence opt4 from VP1__Norovirus__AFJ21391
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacagcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcagcgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccaggaguacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcgugcacuucacccccaagcugggcagaauccaguucagcaccgacaccagcaacgacuucgagaccggccagaacaccagauucacccccgugggcguggugcaggacggcagcaccacccaccagaacgagccccagcagugggugcugcccaacuacagcggcagagacagccacaacgugcaccuggcccccgccguggcccccagcuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22596 - RNA, 1623 nt, Artificial Sequence
  derived and/or modified sequence opt4 from VP1__Norovirus__AFJ21392
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacgccugggugaaccaguucuacacccuggcccccaugggcaacggcaccggcagaaagagagcccuguga

SEQ ID NO: 22597 - RNA, 1623 nt, Artificial Sequence; identical to SEQ ID NO: 22535
  derived and/or modified sequence opt4 from VP1__Norovirus__AFJ21393

SEQ ID NO: 22598 - RNA, 1623 nt, Artificial Sequence; identical to SEQ ID NO: 22522
  derived and/or modified sequence opt4 from VP1__Norovirus__AFJ21394

SEQ ID NO: 22599 - RNA, 1623 nt, Artificial Sequence; identical to SEQ ID NO: 22535
  derived and/or modified sequence opt4 from VP1__Norovirus__AFJ21395

SEQ ID NO: 22600 - RNA, 1623 nt, Artificial Sequence; identical to SEQ ID NO: 22522
  derived and/or modified sequence opt4 from VP1__Norovirus__AFJ21396

SEQ ID NO: 22601 - RNA, 1623 nt, Artificial Sequence
  derived and/or modified sequence opt4 from VP1__Norovirus__AFJ21397
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacagcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggaccccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccaggaguacaccaugaaccuggccagccagaacuggaacaacuacgaccccaccgaggagauccccgccccccugggcacccccgacuucgugggcaagauccagggcgugcugacccagaccaccagaggcgacggcagcaccagaggccacaaggccaccgugagcaccggcagcgugcacuucacccccaagcugggcagaauccaguucagcaccgacaccagcaacgacuucgagaccggccagaacaccagauucacccccgugggcguggugcaggacggcagcaccacccaccagaacgagccccagcagugggugcugcccaacuacagcggcagagacagccacaacgugcaccuggcccccgccguggcccccagcuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22602 - RNA, 1623 nt, Artificial Sequence
  derived and/or modified sequence opt4 from VP1__Norovirus__AFJ21398
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugauccccagcaacggcuacuucagauucgacagcugggugaaccaguucuacacccuggcccccaugggcaacggcaccggcagaagaagagcccuguga

SEQ ID NO: 22603 - RNA, 1623 nt, Artificial Sequence
  derived and/or modified sequence opt4 from VP1__Norovirus__AFJ21399
augaagauggccagcaacgacgccagccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccgcccugaacuggaacaacuacgaccccaccgaggagauccccgccccccugggcacccccgacuucgugggcaagauccagggcgugcugacccagaccaccaaggccgacggcagcaccagaggccacaaggccaccguguacaccggcagcgccgacuucacccccaagcugggcagcgugcaguucagcaccgacaccgagaacgacuucgagacccaccagaacaccaaguucacccccgugggcgugauccaggacggcaacaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22604 - RNA, 1623 nt, Artificial Sequence; identical to SEQ ID NO: 22602
  derived and/or modified sequence opt4 from VP1__Norovirus__AFJ21400

SEQ ID NO: 22605 - RNA, 1623 nt, Artificial Sequence
  derived and/or modified sequence opt4 from VP1__Norovirus__AFJ21401
augaagauggccagcaacgacgccaaccccagcgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagagacuacaccaugaaccuggccagccugaacuggaacaacuacgaccccaccgaggagacccccgccccccugggcacccccgacuucgugggcaagauccagggcaugcugacccagaccaccaagggcgacggcagcaccagaggccacaaggccaccguguacaccggcagcgcccccuucacccccaagcugggcagcgugagauucagcaccgacaccgagaacgacuucgagacccaccagaacaccaaguucacccccgugggcgugauccaggacggcagcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22606 - RNA, 1623 nt, Artificial Sequence
  derived and/or modified sequence opt4 from VP1__Norovirus__AFJ21402
augaagauggccagcaacgacgccaaccccagcgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagagacuacaccaugaaccuggccagccugaacuggaacaacuacgaccccaccgaggagauccccgccccccugggcacccccgacuucgugggcaagauccagggcaugcugacccagaccaccaagggcgacggcagcaccagaggccacaaggccaccguguacaccggcagcgcccccuucacccccaagcugggcagcgugagauucagcaccgacaccgagaacgacuucgagacccaccagaacaccaaguucacccccgugggcgugauccaggacggcagcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22607 - RNA, 1623 nt, Artificial Sequence; identical to SEQ ID NO: 22606
  derived and/or modified sequence opt4 from VP1__Norovirus__AFJ21403

SEQ ID NO: 22608 - RNA, 1623 nt, Artificial Sequence; identical to SEQ ID NO: 22606
  derived and/or modified sequence opt4 from VP1__Norovirus__AFJ21404

SEQ ID NO: 22609 - RNA, 1623 nt, Artificial Sequence
  derived and/or modified sequence opt4 from VP1__Norovirus__AFJ21405
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgccgacuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaacuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagcccggcuacgugaccguggcccacaccggccagcacgaccuggugaucccccccaacggcuacuucagauucgacagcugggugaaccaguucuacacccuggcccccaugggcaacggcgccggcagaagaagagcccuguga

SEQ ID NO: 22610 - RNA, 1623 nt, Artificial Sequence; identical to SEQ ID NO: 22112
  derived and/or modified sequence opt4 from VP1__Norovirus__AFJ21406

SEQ ID NO: 22611 - RNA, 1623 nt, Artificial Sequence
  derived and/or modified sequence opt4 from VP1__Norovirus__AFJ21407
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccugggugagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagccacaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcaccgaguucagccccaagcugggcagagugcaguucgccaccgacaccaacaacgacuucgacgccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22612 - RNA, 1623 nt, Artificial Sequence
  derived and/or modified sequence opt4 from VP1__Norovirus__AFJ21409
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccacccagaacuggaacagcuacgaccccaccgaggagauccccgccccccugggcacccccgacuucgugggcaagauccagggcgugcugacccagaccaccagagccgacggcagcaccagaggccacaaggccaccguguacaccggcagcgccgacuucgcccccaagcugggcagagugcaguucgccaccgacaccgacaacgacuucgacgccaaccagaacaccaaguucacccccgugggcgugauccaggacggcgacaccgcccacagaaacgagccccagcagugggugcugcccagcuacagcggcagaaacagccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22613 - RNA, 1623 nt, Artificial Sequence
  derived and/or modified sequence opt4 from VP1__Norovirus__AFJ21410
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucguguucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagccacaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgaguucagccccaagcugggcagagugcaguucgccaccgacaccaacaacgacuucgacgccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22614 - RNA, 1623 nt, Artificial Sequence; identical to SEQ ID NO: 22613
  derived and/or modified sequence opt4 from VP1__Norovirus__AFJ21411

SEQ ID NO: 22615 - RNA, 1623 nt, Artificial Sequence; identical to SEQ ID NO: 22613
  derived and/or modified sequence opt4 from VP1__Norovirus__AFJ21413

SEQ ID NO: 22616 - RNA, 1623 nt, Artificial Sequence; identical to SEQ ID NO: 22112
  derived and/or modified sequence opt4 from VP1__Norovirus__AFJ21414

SEQ ID NO: 22617 - RNA, 1623 nt, Artificial Sequence; identical to SEQ ID NO: 22613
  derived and/or modified sequence opt4 from VP1__Norovirus__AFJ21415

SEQ ID NO: 22618 - RNA, 1623 nt, Artificial Sequence; identical to SEQ ID NO: 22112
  derived and/or modified sequence opt4 from VP1__Norovirus__AFJ21416

SEQ ID NO: 22619 - RNA, 1623 nt, Artificial Sequence; identical to SEQ ID NO: 22613
  derived and/or modified sequence opt4 from VP1__Norovirus__AFJ21417

SEQ ID NO: 22620 - RNA, 1623 nt, Artificial Sequence
  derived and/or modified sequence opt4 from VP1__Norovirus__AFJ21418
augaagauggccagcagcgacgccaaccccagcgacggcagcaccgccaaccuggugcccgaggugaacaacgaggugauggcccuggagcccguggugggcgccgccaucgccgcccccguggccggccagcagaacaucaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucguguucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagccacaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgaguucagccccaagcugggcagaauccaguucgccaccgacaccaacaacgacuucgacgccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcacccugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22621 - RNA, 1623 nt, Artificial Sequence
  derived and/or modified sequence opt4 from VP1__Norovirus__AFJ21419
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcaccuucguggugcagccccagaacggcagaugcaccaccgacggcgugcugcugggcaccacccagcugagccccgugaacaucugcaccuucagaggcgacgugacccacaucgccggcagccacaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgaguucagccccaagcugggcagagugcaguucgccaccgacaccaacaacgacuucgacgccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugaucccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22622 - RNA, 1623 nt, Artificial Sequence; identical to SEQ ID NO: 22613
  derived and/or modified sequence opt4 from VP1__Norovirus__AFJ21420

SEQ ID NO: 22623 - RNA, 1623 nt, Artificial Sequence
  derived and/or modified sequence opt4 from VP1__Norovirus__AFJ21421
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucguguucgccguggugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagccacaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgaguucagccccaagcugggcagagugcaguucgccaccgacaccaacaacgacuucgacgccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaucggccagcacgaccuggugaucccccccaacggcuacuucagauucgacagcugggugaaccaguucuacacccuggcccccaugggcaacggcaccggcagaagaagagcccuguga

SEQ ID NO: 22624 - RNA, 1623 nt, Artificial Sequence; identical to SEQ ID NO: 22613
  derived and/or modified sequence opt4 from VP1__Norovirus__AFJ21422

SEQ ID NO: 22625 - RNA, 1623 nt, Artificial Sequence; identical to SEQ ID NO: 22108
  derived and/or modified sequence opt4 from VP1__Norovirus__AFJ21423

SEQ ID NO: 22626 - RNA, 1623 nt, Artificial Sequence; identical to SEQ ID NO: 22112
  derived and/or modified sequence opt4 from VP1__Norovirus__AFJ21424

SEQ ID NO: 22627 - RNA, 1623 nt, Artificial Sequence
  derived and/or modified sequence opt4 from VP1__Norovirus__AFJ21425
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacaacuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22628 - RNA, 1623 nt, Artificial Sequence; identical to SEQ ID NO: 22112
  derived and/or modified sequence opt4 from VP1__Norovirus__AFJ21426

SEQ ID NO: 22629 - RNA, 1623 nt, Artificial Sequence
  derived and/or modified sequence opt4 from VP1__Norovirus__AFJ21428
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccgccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22630 - RNA, 1623 nt, Artificial Sequence; identical to SEQ ID NO: 22112
  derived and/or modified sequence opt4 from VP1__Norovirus__AFJ21429

SEQ ID NO: 22631 - RNA, 1623 nt, Artificial Sequence; identical to SEQ ID NO: 22112
  derived and/or modified sequence opt4 from VP1__Norovirus__AFJ21430

SEQ ID NO: 22632 - RNA, 1623 nt, Artificial Sequence; identical to SEQ ID NO: 22112
  derived and/or modified sequence opt4 from VP1__Norovirus__AFJ21431

SEQ ID NO: 22633 - RNA, 1623 nt, Artificial Sequence
  derived and/or modified sequence opt4 from VP1__Norovirus__AFJ21432
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacacccccggcagccacaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22634 - RNA, 1623 nt, Artificial Sequence
  derived and/or modified sequence opt4 from VP1__Norovirus__AFJ21433
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccgugcaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22635 - RNA, 1623 nt, Artificial Sequence
  derived and/or modified sequence opt4 from VP1__Norovirus__AFJ21434
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22636 - RNA, 1623 nt, Artificial Sequence; identical to SEQ ID NO: 22112
  derived and/or modified sequence opt4 from VP1__Norovirus__AFJ21436

SEQ ID NO: 22637 - RNA, 1623 nt, Artificial Sequence; identical to SEQ ID NO: 22635
  derived and/or modified sequence opt4 from VP1__Norovirus__AFJ21437

SEQ ID NO: 22638 - RNA, 1623 nt, Artificial Sequence
  derived and/or modified sequence opt4 from VP1__Norovirus__AFJ21438
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaucggccaguacgaccuggugaucccccccaacggcuacuucagauucgacagcugggugaaccaguucuacacccuggcccccaugggcaacggcaccggcagaagaagagcccuguga

SEQ ID NO: 22639 - RNA, 1623 nt, Artificial Sequence; identical to SEQ ID NO: 22108
  derived and/or modified sequence opt4 from VP1__Norovirus__AFJ21439

SEQ ID NO: 22640 - RNA, 1623 nt, Artificial Sequence
  derived and/or modified sequence opt4 from VP1__Norovirus__AFJ21440
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagagccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22641 - RNA, 1623 nt, Artificial Sequence
  derived and/or modified sequence opt4 from VP1__Norovirus__AFJ21441
augaagauggccagcagcgacgccaaccccagcgacggcagcaccgccaaccuggugcccgaggugaacaccgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacgccgcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22642 - RNA, 1623 nt, Artificial Sequence
  derived and/or modified sequence opt4 from VP1__Norovirus__AFJ21442
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagagcuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgccgacuucacccccaagcugggcagcgugcaguucggcaccgacaccgacaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaacuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaaagagagcccuguga

SEQ ID NO: 22643 - RNA, 1623 nt, Artificial Sequence
  derived and/or modified sequence opt4 from VP1__Norovirus__AFJ21443
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaugaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacacccccggcagccacaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22644 - RNA, 1623 nt, Artificial Sequence
  derived and/or modified sequence opt4 from VP1__Norovirus__AFJ21444
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaccgccggcagccacaacuacaccaugaaccuggccagccagaacuggaacagcuacgaccccaccgaggagauccccgccccccugggcacccccgacuucgugggcaagauccagggcgugcugacccagaccaccagagccgacggcagcaccagaggccacaaggccaccguguacaccggcagcgccgaguucagccccaagcugggcagagugcaguucgccaccgacaccgacaacgacuucgacgccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22645 - RNA, 1623 nt, Artificial Sequence; identical to SEQ ID NO: 22112
  derived and/or modified sequence opt4 from VP1__Norovirus__AFJ21445

SEQ ID NO: 22646 - RNA, 1623 nt, Artificial Sequence
  derived and/or modified sequence opt4 from VP1__Norovirus__AFJ21446
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccgugccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22647 - RNA, 1623 nt, Artificial Sequence; identical to SEQ ID NO: 22112
  derived and/or modified sequence opt4 from VP1__Norovirus__AFJ21448

SEQ ID NO: 22648 - RNA, 1623 nt, Artificial Sequence
  derived and/or modified sequence opt4 from VP1__Norovirus__AFJ21451
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagacccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcaugcugacccagaccacccagggcgacggcagcaccagaggccacaaggccaccguguacaccggcagcgccgacuucacccccaagcugggcagcgugcaguucgccaccgacaccgagaacgacuucgagacccaccagaacaccaaguucacccccgugggcgugauccaggacggcagcaccacccacagaaacgagccccagcagugggcccugcccagcuacagcggcagaagcgcccacaacgugcaccuggcccccgccguggcccccaacuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22649 - RNA, 1623 nt, Artificial Sequence
  derived and/or modified sequence opt4 from VP1__Norovirus__AFJ21454
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccagcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccacagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22650 - RNA, 1623 nt, Artificial Sequence
  derived and/or modified sequence opt4 from VP1__Norovirus__AFL70023
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccuggcccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucgugguggacgugagacagcuggagcccgugcugaucccccugcccgacgugggcaacaacuucuaccacuacaaccagagcaacgaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcacccacaacuacaccaugaaccuggccagccagaacuggaacaacuacgaccccaccgaggagauccccgccccccugggcacccccgacuucgugggcagaauccagggcaugcugacccagaccaccagaggcgacggcagcaccagaggccacaaggccaccgugagcaccggcgacgugcacuucacccccaagcugggcagcauccaguucaacaccgacaccaacaacgacuucgagaccggccagaacaccaaguucacccccgugggcguggugcaggacggcaacggcgcccaccagaacgagccccagcagugggugcugcccagcuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22651 - RNA, 1653 nt, Artificial Sequence
  derived and/or modified sequence opt4 from VP1__Norovirus__AFN06724
augaagauggccagcaacgacgccgcccccagcaacgacggcgccgccaaccuggugcccgaggccaacaacgaggugauggcccuggagcccguggugggcgccagcaucgccgcccccguggugggccagcagaacaucaucgaccccuggaucagagagaacuucgugcaggccccccagggcgaguucaccgugagccccagaaacagccccggcgagaugcugcugaaccuggagcugggccccgagcugaaccccuaccugagccaccugagcagaauguacaacggcuacgccggcggcaugcaggugcagguggugcuggccggcaacgccuucaccgccggcaagaucaucuucgccgccgugcccccccacuuccccguggagaacaucagcgccgcccagaucaccaugugcccccacgugaucguggacgugagacagcuggagcccgugcugcugccccugcccgacaucagaaacagauucuuccacuacaaccaggagagcacccccagaaugagacugaucgccaugcuguacaccccccugagagccaacagcggcgaggacguguucaccgugagcugcagagugcugaccagacccgcccccgacuucgaguucaccuuccuggugccccccaccguggagagcaagaccaagcccuucacccugcccauccugacccugggcgagcugagcaacagcagauuccccgccgccaucgacaugcuguacaccgaccccaacgagagcaucguggugcagccccagaacggcagaugcacccuggacggcacccugcagggcaccacccagcuggugcccacccagaucugcgccuucagaggcacccugaucagccagaccgccagagccgccgacagcaccgacagcccccagagagccagagaccacccccugcacgugcaggugaagaaccuggacggcacccaguacgaccccaccgacgacauccccgccgugcugggcgccaucgacuucaagggcaccguguucggcguggccagccagagagacgugagcggccagcaggagcagggccacuacgccaccagagcccacgaggcccacaucgacaccaccgaccccaaguacgcccccaagcugggcaccauccugaucaagagcgagagcaacgacuucaccaccaaccagcccaucagauucacccccgugggcaugggcgacaacaacuggagacagugggagcugcccgacuacagcggcagacugacccugaacaugaaccuggcccccgccgugagccccagcuuccccggcgagagaauccuguucuucagaagcaucgugcccagcgccggcggcuucggcagcggcuacaucgacugccugaucccccaggagugggugcagcacuucuaccaggaggccgcccccagccagagcgccguggcccuggugagauacgugaaccccgacaccggcagaaacaucuucgaggccaagcugcacagagagggcuuccugaccguggccaacagcggcaacaaccccaucguggugccccccaacggcuacuucagauucgaggccugggugaaccaguucuacacccuggcccccaugggcagcggccagggcagaagaagagcccaguga

SEQ ID NO: 22652 - RNA, 1653 nt, Artificial Sequence
  derived and/or modified sequence opt4 from VP1__Norovirus__AFN06725
augaagauggccagcaacgacgccgcccccagcaacgacggcgccgccaaccuggugcccgaggccaacaacgaggugauggcccuggagcccguggugggcgccagcaucgccgcccccguggugggccagcagaacaucaucgaccccuggaucagagagaacuucgugcaggccccccagggcgaguucaccgugagccccagaaacagccccggcgagaugcugcugaaccuggagcugggccccgagcugaaccccuaccugagccaccugagcagaauguacaacggcuacgccggcggcaugcaggugcagguggugcuggccggcaacgccuucaccgccggcaagaucaucuucgccgccgugcccccccacuuccccguggagaacaucagcgccgcccagaucaccaugugcccccacgugaucguggacgugagacagcuggagcccgugcugcugccccugcccgacaucagaaacagauucuuccacuacaaccaggagaacacccccagaaugagacugaucgccaugcuguacaccccccugagagccaacagcggcgaggacguguucaccgugagcugcagagugcugaccagacccgcccccgacuucgaguucaccuuccuggugccccccaccguggagagcaagaccaagcccuucacccugcccauccugacccugggcgagcugagcaacagcagauuccccgccgccaucgacaugcuguacaccgaccccaacgagagcaucguggugcagccccagaacggcagaugcacccuggacggcacccugcagggcaccacccagcuggugcccacccagaucugcgccuucagaggcacccugaucagccagaccgccagagccgccgacagcaccgacagcccccagagagccagagaccacccccugcacgugcaggugaagaaccuggacggcacccaguacgaccccaccgacgacauccccgccgugcugggcgccaucgacuucaagggcaccguguucggcguggccagccagagagacgugagcggccagcaggagcagggccacuacgccaccagagcccacgaggcccacaucgacaccaccgaccccaaguacgcccccaagcugggcaccauccugaucaagagcgagagcaacgacuucaccaccaaccagcccaucagauucacccccgugggcaugggcgacaacaacuggagacagugggagcugcccgacuacagcggcagacugacccugaacaugaaccuggcccccgccgugagccccagcuuccccggcgagagaauccuguucuucagaagcaucgugcccagcgccggcggcuucggcagcggcuacaucgacugccugaucccccaggagugggugcagcacuucuaccaggaggccgcccccagccagagcgccguggcccuggugagauacgugaaccccgacaccggcagaaacaucuucgaggccaagcugcacagagagggcuuccugaccguggccaacagcggcaacaaccccaucguggugccccccaacggcuacuucagauucgaggccugggugaaccaguucuacacccuggcccccaugggcagcggccagggcagaagaagagcccaguga

SEQ ID NO: 22653 - RNA, 1629 nt, Artificial Sequence
  derived and/or modified sequence opt4 from VP1__Norovirus__AFN06726
augaagauggccagcaacgacgccgcccccagcaccgacggcgccgccggccuggugcccgagagcaacagcgaggugauggcccuggagcccguggccggcgccgcccuggccgcccccgugaccggccagaccaacaucaucgaccccuggaucagagccaacuucgugcaggcccccaacggcgaguucaccgugagccccagaaacgcccccggcgaggugcugcugaaccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccguggagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauuccccgugagcaucgaccagauguacaccagccccaacgaggugaucagcgugcagugccagaacggcagaugcacccuggacggcgagcugcagggcaccacccagcugcaggugagcggcaucugcgccuucaagggcgaggugaccgcccaccugcaggacaacgaccaccuguacaacaucaccaucaccaaccugaacggcagccccuucgaccccagcgaggacauccccgccccccugggcgugcccgacuuccagggcagaguguucggcgugaucacccagagagacaagcagaacgccgccggccagagccagcccgccaacagaggccacgacgccguggugcccaccuacaccgcccaguacacccccaagcugggccaggugcagaucggcaccuggcagaccgacgaccugaaggugaaccagcccgugaaguucacccccgugggccugaacgacaccgagcacuucaaccaguggguggugcccagauacgccggcgcccugaaccugaacaccaaccuggcccccagcguggcccccguguuccccggcgagagacugcuguucuucagaagcuaccugccccugaagggcggcuacggcaaccccgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagaauccaguga

SEQ ID NO: 22654 - RNA, 1617 nt, Artificial Sequence
  derived and/or modified sequence opt4 from VP1__Norovirus__AFN06727
augaagauggccagcaacgacgccacccccagcgacgacggcgccgccggccuggugcccgagaucaacaacgaggugauggcccuggagcccguggccggcgccagcaucgccgcccccguggugggccagcagaacaucaucgaccccuggaucagaaacaacuucgugcaggcccccgccggcgaguucaccgugagccccagaaacagccccggcgagcugcugcuggaccuggagcugggccccgagcugaaccccuaccuggcccaccuggccagaauguacaacggccacgccggcggcauggaggugcagaucgugcuggccggcaacgccuucaccgccggcaagauccuguucgccgccaucccccccagcuuccccuacgagaaccugagccccgcccagcugaccaugugcccccacgugaucguggacgugagacagcuggagcccgugcugcugcccaugcccgacaucagaaacguguucuaccacuacaaccagaacaacagccccaagcugagacugguggccaugcuguacaccccccugagagccaacaacagcggcgacgacguguucaccgugagcugcagagugcugaccagacccagccccgacuuccaguucaccuuccuggugccccccaccguggagagcaagaccaagaacuucacccugcccgugcugagagugagcgagaugaccaacagcagauuccccguggugcuggaccagauguacaccagcagaaacgagaacaucaucgugcagccccagaacggcagaugcaccaccgacggcgagcugcugggcaccaccauccugcagagcgugagcaucugcaacuucaagggcaccaugcaggccgagcugagcgaccagcccagauaccaguaccagcugcagcugaccaaccuggacggcagccccaucgaccccaccgacgacgugcccgccccccugggcacccccgacuuccaggccaugcuguacggcguggccagccagagaagcagcagagacaacgccaccagagcccacgacgcccagaucgacaccgccggcgacaccuucgcccccaagaucggccaggugagauucaagagcagcagcaacgacuucgaccugcacgaccccaccaaguucacccccaucggcgugaacguggacgaccagcaccccuucagacaguggagccugcccaacuacggcggccaccuggcccugaacaaccaccuggcccccgccgugaccccccuguuccccggcgagcagauccuguucuucagaagcuacauccccagcgccggcggccacaccgacggcgccauggacugccugcugccccaggaguggaucgagcacuucuaccaggagagcgcccccagccagagcgacaucgcccuggugagauucaucaaccccgacaccggcagagugcuguucgaggccaagcugcacaagcagggcuuccugaccaucgccgccagcggcgaccaccccaucgugaugcccaccaacggcuacuucagauucgaggccugggugaaccccuucuacacccuggcccccgugggcaccggcagcggcagaagaagaauccaguga

SEQ ID NO: 22655 - RNA, 1647 nt, Artificial Sequence
  derived and/or modified sequence opt4 from VP1__Norovirus__AFN06728
augaagauggccagcaacgacgccgcccccagcaacgacggcgccgccggccuggugcccgagaucaacaacgaggccauggcccuggagcccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgccuucaccgccggcaaggugaucuucgccgccaucccccccaacuuccccaucgacaaccugagcgccgcccagaucaccaugugcccccacgugaucguggacgugagacagcuggagcccaucaaccugcccaugcccgacgugagaaacaacuucuuccacuacaaccagggcagcgacagcagacugagacugaucgccaugcuguacaccccccugagagccaacaacagcggcgacgacguguucaccgugagcugcagagugcugaccagacccagccccgacuucagcuucaacuuccuggugccccccaccguggagagcaagaccaagcccuucacccugcccauccugaccaucagcgagaugagcaacagcagauuccccgugcccaucgacagccugcacaccagccccaccgagaacaucguggugcagugccagaacggcagagugacccuggacggcgagcugaugggcaccacccagcugcugcccagccagaucugcgccuucagaggcacccugaccagaagcaccagcagagccagcgaccaggccgacaccgccacccccagacuguucaacuacuacuggcacauccagcuggacaaccugaacggcacccccuacgaccccgccgaggacauccccgccccccugggcacccccgacuucagaggcaagguguucggcguggccagccagagaaaccccgacagcaccaccagagcccacgaggccaagguggacaccaccagcggcagauucacccccaagcugggcagccuggagaucagcaccgagagcgacgacuucgaccccaaccagcccaccagauucacccccgugggcaucggcguggacaacgaggccgacuuccagcaguggagccugcccgacuacagcggccaguucacccacaacaugaaccuggcccccgccguggcccccaacuuccccggcgagcagcugcuguucuucagaagccagcugcccagcagcggcggcagaagcaacggcauccuggacugccuggugccccaggagugggugcagcacuucuaccaggagagcgcccccgcccagacccagguggcccuggugagauacgugaaccccgacaccggcagagugcuguucgaggccaagcugcacaagcugggcuucaugaccaucgccaagaacggcgacagccccaucaccgugccccccaacggcuacuucagauucgagagcugggugaaccccuucuacacccuggcccccaugggcaccggcaacggcagaagaagaauccaguga

SEQ ID NO: 22656 - RNA, 1647 nt, Artificial Sequence
  derived and/or modified sequence opt4 from VP1__Norovirus__AFN06729
augaagauggccagcaacgacgccgcccccagcaacgacggcgccgccggccuggugcccgagaucaacaacgaggccauggcccuggagcccguggugggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgccuucaccgccggcaaggugaucuucgccgccaucccccccaacuuccccaucgacaaccugagcgccgcccagaucaccaugugcccccacgugaucguggacgugagacagcuggagcccaucaaccugcccaugcccgacgugagaaacaacuucuuccacuacaaccagggcagcgacagcagacugagacugaucgccaugcuguacaccccccugagagccaacaacagcggcgacgacguguucaccgugagcugcagagugcugaccagacccagccccgacuucagcuucaacuuccuggugccccccaccguggagagcaagaucaagcccuucacccugcccauccugaccaucagcgagaugagcaacagcagauuccccgugcccaucgacagccugcacaccagccccaccgagaacaucguggugcagugccagaacggcagagugacccuggacggcgagcugaugggcaccacccagcugcugcccagccagaucugcgccuucagaggcacccugaccagaagcaccagcagagccagcgaccaggccgacaccgccacccccagacuguucaacuacuacuggcacauccagcuggacaaccugaacggcacccccuacgaccccgccgaggacauccccgccccccugggcacccccgacuucagaggcaagguguucggcguggccagccagagaaaccccgacagcaccaccagagcccacgaggccaagguggacaccaccagcggcagauucacccccaagcugggcagccuggagaucagcaccgagagcggcgacuucgaccccaaccagcccaccagauucacccccgugggcaucggcguggacaacgaggccgacuuccagcaguggagccugcccgacuacagcggccaguucacccacaacaugcaccuggcccccgccguggcccccaacuuccccggcgagcagcugcuguucuucagaagccagcugcccagcagcggcggcagaagcaacggcauccuggacugccuggugccccaggagugggugcagcacuucuaccaggagagcgcccccgcccagacccagguggcccuggugagauacgugaaccccgacaccggcagagugcuguucgaggccaagcugcacaagcugggcuucaugaccaucgccaagaacggcgacagccccaucaccgugccccccaacggcuacuucagauucgagagcugggugaaccccuucuacacccuggcccccaugggcaccggcaacggcagaagaagaauccaguga

SEQ ID NO: 22657 - RNA, 1644 nt, Artificial Sequence
  derived and/or modified sequence opt4 from VP1__Norovirus__AFN06730
augaagauggccagcaacgacgccgcccccagcaacgacggcgccgccaaccuggugcccgaggccaacaacgaggugauggcccuggagcccguggugggcgccagcaucgccgcccccguggugggccagcagaacaucaucgaccccuggaucagagagaacuucgugcaggccccccagggcgaguucaccgugagccccagaaacagccccggcgagaugcugcugaaccuggagcugggccccgagcugaaccccuaccugagccaccugagcagaauguacaacggcuacgccggcggcaugcaggugcagguggugcuggccggcaacgccuucaccgccggcaagaucaucuucgccgccgugcccccccacuuccccguggagaacaucagcgccgcccagaucaccaugugcccccacgugaucguggacgugagacagcuggagcccgugcugcugccccugcccgacaucagaaacagauucuuccacuacaaccaggagaacacccccagaaugagacugguggccaugcuguacaccccccugagagccaacagcggcgaggacguguucaccgugagcugcagagugcugaccagacccgcccccgacuucgaguucaccuuccuggugccccccaccguggagagcaagaccaagcccuucacccugcccauccugacccugggcgagcugagcaacagcagauuccccgcccccaucgacaugcuguacaccgaccccaacgagaccaucguggugcagccccagaacggcagaugcacccuggacggcacccugcagggcaccacccagcuggugcccacccagaucugcagcuucagaggcacccugaucagccagaccagcagaagcgccgagagcaccgacagcgcccccagagugagaaaccacccccugcacgugcagcugaagaaccuggacggcacccccuacgaccccaccgacgaggugcccgccgugcugggcgccaucgacuucaagggcaccguguucggcguggccagccagagaaacaccaccggcagcagcgccggcgccaccagagcccacgaggugcacaucgacaccaccaaccccagauacacccccaagcugggcagcgugcugauguacagcgagagcaccgacuucgacgacggccagcccaccagauucacccccaucggcaugggcgccgacgacuggagacagugggagcugcccgaguacagcggccaccugacccugaacaugaaccuggcccccgccguggcccccgccuuccccggcgagagaauccuguucuucagaagcguggugcccagcgccggcggcuacggcagcggccagaucgacugccugaucccccaggagugggugcagcacuucuaccaggaggccgcccccagccagagcgccguggcccugaucagauacgugaaccccgacaccggcagaaacaucuucgaggccaagcugcacagagagggcuucaucaccguggccaacagcggcaacaaccccaucguggugccccccaacggcuacuucagauucgaggccugggugaaccaguucuacacccugacccccaugggcaccggccagggcagaagaagagugcaguga

SEQ ID NO: 22658 - RNA, 1623 nt, Artificial Sequence
  derived and/or modified sequence opt4 from VP1__Norovirus__AFN06731
augaagauggccagcaacgacgccgcccccagcagcgacggcgccgccggccuggugcccgagaucaacaacgaggugaugccccuggagcccguggccggcgccagccuggccacccccguggugggccagcagaacaucaucgaccccuggaucagaaacaacuucgugcaggcccccgccggcgaguucaccgugagccccagaaacagccccggcgagauccugcuggaccuggagcugggccccgagcugaaccccuaccuggcccaccuggccagaauguacaacggccacgccggcggcauggaggugcagaucgugcuggccggcaacgccuucaccgccggcaagaucaucuucgccgccaucccccccggcuuccccuacgagaaccugagccccagccagaucaccaugugcccccacgugaucaucgacgugagacagcuggagcccgugcugcugcccaugcccgacaucagaaacaacuucuuccacuacaaccagggcaacgaccccaagcugagacugguggccaugcuguacaccccccugagagccaacaacagcggcgacgacguguucaccgugagcugcagagugcugaccaagcccagccccgacuucgaguucaccuuccuggugccccccaccguggagagcaagaccaagcaguucacccugcccauccugaagaucagcgagaugaccaacagcagauuccccgugcccguggacgugauguacaccgccagaaacgagaaccagguggugcagccccagaacggcagagugacccuggacggcgagcugcugggcaccaccccccugcuggccgugaacaucugcaaguucaagggcgaggugaucgccaagaacggcgacgugagaagcuacagaauggacauggagaucaccaacaccgacggcacccccaucgaccccaccgaggacacccccggccccaucggcagccccgacuuccagggcauccuguucggcguggccagccagagaaacaagaacgagcagaaccccgccaccagagcccacgaggccaacaucaacaccggcggcgaccaguacgcccccaagcuggcccaggugaaguucuucagcgagagccaggacuucgaggugcaccagcccaccaucuucacccccgugggcguggccggcgacaccagccaccccuucagacaguggacccugcccagauacggcggccaccugaccaacaacacccaccuggcccccgccguggccccccuguuccccggcgagcagcugcuguucuucagaagccagauccccagcagcggcggccacgagcagggcuacauggacugccuggugccccaggagugggugcagcacuucuaccaggaggccgccaccgcccagagcgagguggcccugaucagauucaucaaccccgacaccggcagagugcuguucgaggccaagcugcacaagcagggcuucaucaccguggcccacaccggcgacaaccccaucgugaugccccccaacggcuacuucagauucgaggccugggugaaccaguucuacagccuggcccccgugggcaccggcaacggcagaagaagagugcaguga

SEQ ID NO: 22659 - RNA, 1623 nt, Artificial Sequence
  derived and/or modified sequence opt4 from VP1__Norovirus__AFN06732
augaagauggccagcaacgacgccgcccccagcaacgacggcgccaccggccuggugcccgagaucaaccacgagacccugccccuggagcccguggccggcgccgccaucgccgcccccgugaccggccagaacaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacaacaaccagcccgccaacagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucagccugcccauccugaccaucagcgagcugaccaacagcagauuccccgcccccaucgacagccuguacaccgcccagaacaacaaccugaacgugcagugccagaacggcagaugcacccuggacggcgagcugcagggcaccacccagcugcugcccagcggcaucugcgccuucagaggcaagcugaccgccgacgugcaccagagccacgacgacagauggcacaugcagcugaccaaccugaacggcacccccuucgaccccaccgaggacgugcccgccccccugggcacccccgacuucaccggccugcuguucggcguggccagccagagaaacguggugagcaaccccaacaccaccagagcccacgaggccgugaucagcaccaccagcagccaguucgugcccaagcugggcagcaucaacuucggcagcaccagcgacgacuuccagcugcagcagcccaccaaguucacccccgugggcaucaagguggagagcggccacgacuucgaccagugggcccugcccagauacagcggccaccugacccugaacaugaaccuggccccccccguggcccccaacuuccccggcgagcagcugcuguucuucagaagcaacgugcccugcgccggcggcgugagcgacggcgugaucgacugccugcugccccaggaguggauccagcacuucuaccaggagagcgcccccagccagagcgacguggcccugaucagauacgugaaccccgacaccggcagaacccuguucgaggccaagcugcacagaaccggcuacaucaccguggcccacagcggcgacuacccccugguggugcccagcaacggcuacuucagauucgacagcugggugaaccaguucuacagccuggcccccaugggcaccggcaacggcagaagaagagugcaguga

SEQ ID NO: 22660 - RNA, 1623 nt, Artificial Sequence
  derived and/or modified sequence opt4 from VP1__Norovirus__AFN06733
augaagauggccagcaacgacgccgcccccagcaacgacggcgccgccggccuggugcccgagagcagcaacgaggccauggcccuggagcccguggugggcgccagccuggccgcccccgugaccggccagaccaacaucaucgaccccuggaucagaaccaacuucgugcaggcccccaacggcgaguucaccgugagccccagaaacagccccggcgaggugcuggugaaccuggagcugggccccgagcugaaccccuaccuggcccaccuggccaugauguacaacggcuacgccggcggcauggaggugcaggugcugcuggccggcaacgccuucaccgccggcaagaucaucuucgccgccgugccccccuacuuccccguggagaaccugagccccagccagaucaccauguucccccacgugaucaucgacgugagaacccuggagcccgugcugcugcccaugcccgacgugagaagcacccuguuccacuucaaccagaaggacgagcccaagaugagacugguggccaugcuguacaccccccugagaagcaacggcagcggcgacgacguguucaccgugagcugcagaauccugaccagacccagccccgaguucgacuucaccuaccuggugccccccaccguggagagcaagaccaagcccuucacccugcccgugcugacccugggcgagcugagcaacagcagauucccccugagcaucgacgagauggugaccagccccaacgagagcaucguggugcagccccagaacggcagagugacccuggacggcgagcugcugggcaccacccagcugcaggccugcaacaucugcagcaucagaggcaaggugaccggccaggugcccaacgagcagcacauguggaaccuggagaucaccaaccugaacggcacccaguucgaccccaccgacgacgugcccgccccccugggcgugcccgacuucgccggcgagguguucggcgugcugagccagagaaacagaggcgagagcaaccccgccaacagagcccacgacgccgugguggccaccuacagcgacaaguacacccccaagcugggccuggugcagaucggcaccuggaacaccaacgacguggagaaccagcccaccaaguucacccccaucggccugaacgagguggccaacggccacagauucgagcaguggacccugcccagauacagcggcgcccugacccugaacaugaaccuggcccccgccguggccccccuguuccccggcgagagacugcuguucuucagaagcuacgugccccugaagggcggcuucggcaaccccgccaucgacugccuggugccccaggagugggugcagcacuucuaccaggagagcgcccccagccugggcgacguggcccuggugagauacgugaaccccgacaccggcagagugcuguucgaggccaagcugcacaagggcggcuuccugaccgugagcagcaccagcaccggccccgugguggugcccgccaacggcuacuucagauucgacagcugggugaaccaguucuacagccuggcccccaugggcaccggcaacggcagaagaagauuccaguga

SEQ ID NO: 22661 - RNA, 1623 nt, Artificial Sequence
  derived and/or modified sequence opt4 from VP1__Norovirus__AFN06734
augaugauggccagcaaggacgcccccaccagccccgacggcgccagcggcgccggccagcuggugcccgaggccaacaccgccgagcagaucagcauggaccccguggccggcgccagcaccgccguggccaccgccggccaggugaacaugaucgaccccuggaucuucaacaacuucgugcaggccccccagggcgaguucaccaucagccccaacaacacccccggcgacauccuguucgaccugcagcugggcccccaccugaaccccuuccuggcccaccugagccagauguacaacggcugggugggcaacaugagagugagaauccugcuggccggcaacgccuucaccgccggcaagaucaucaucugcugcgugccccccggcuucgacgccagaauccugaccaucgcccaggccacccuguucccccaccugaucgccgacgugagaacccuggagcccguggagcugccccuggaggacgugagaaacgugcuguuccacaacagcagccagccccagcccaccaugagacugguggccaugcuguacaccccccugagaaccggcggcggcagcggcggcaccgacgccuucgugguggccggcagagugcugaccugccccgcccccgacuucagcuuccuguuccuggugccccccagcguggagcagaagaccagaguguucagcgugcccaacgugccccugaaggaccugagcaacagcagagugcccgugcccauccagggcauguucaugagccccgacgugaaccagagcgugcaguuccagaacggcagaugccagaucgacggccagcugcagggcaccacccccgugagccugagccagcugugcaagaucagaggcaagaccagcagcaacgccagagugcugaaccugagcgagguggacggcacccccuucaucccccuggagagccccgcccccgugggcuuccccgaccugggcggcugcgacuggcacgugaacuucaccuuccaggcccagaaccaggaccccagccagagcgugaccuucgccaccaacgacgccagcuucgugcccuaccugggcagcaucagcccccacaacggcggcgacuuccacagcggcgacaucaucggcagccugggcuggaucagcgcccccagcgacagcagccagcugaacguguggaccauccccaaguacggcagcagccugcccgacgugacccaccuggcccccgccguguucccccccggcuucggcgaggugauccuguacuuccacagcaccuuccccggcagcggccagcccggccagcugcaggugcccugccugcugccccaggaguucaucacccacuucugcaacgagcaggcccccaucgccggcgaggccgcccugcugcacuacguggaccccgacaccggcagaaaccugggcgaguucaagcuguaccccgacggcuucaugaccugcgugcccaacagcgugagcagcggcccccagacccugcccaucaacggcguguucguguucgugagcugggugagcagauucuaccagcugaagcccgugggcaccgccagcgccgccagaagacugggccugagaagaaucuga

SEQ ID NO: 22662 - RNA, 1632 nt, Artificial Sequence
  derived and/or modified sequence opt4 from VP1__Norovirus__AFN06735
augaugauggccagcaaggacgccagccccagcgccgacggcgccaacggcgccggccagcuggugcccgaggugaacaacgccgagccccugccccuggaccccguggccggcgccagcaccgcccuggccaccgccggccaggugaacaugaucgaccccuggaucuucaacaacuucgugcaggccccccagggcgaguucaccaucagccccaacaacacccccggcgacauccuguucgaccugcagcugggcccccaccugaaccccuuccuggcccaccugagccagauguacaacggcugggugggcaacaugagagugagagugauccuggccggcaacgccuucaccgccggcaaggugaucaucugcugcgugccccccggcuuccagagcagaacccugagcaucgcccaggccacccuguucccccacaucaucgccgacgugagaacccuggagcccaucgagaucccccuggaggacgugagaaacacccuguaccacaccaacgacaaccagcccaccaugagacugcugugcaugcuguacaccccccugagaaccggcggcggcagcggcggcaccgacgccuucgugguggccggcagagugcugaccugccccagcagcgacuucaacuuccuguuccuggugccccccaccguggagcagaagaccagacccuucagcgugcccaacaucccccugcagcugcugagcaacagcagagugcccaaccugauccagagcauggugcugagccccgaccaggcccagaacgugcaguuccagaacggcagaugcaccaccgacggccagcugcugggcaccacccccgugagcgugagccagauccugaaguucagaggcaaggugagcgccggcagcagagugaucaaccugaccgagcuggacggcagccccuuccuggccuucgaggcccccgcccccaccggcuuccccgaccugggcaccagcgacuggcacguggagaugagccugaacagcaacagccagagcagcggcaaccccauccugcugagagacauccagcccaacagcagcgacuucgugccccaccugggcagcgugagcgugaccaccgccaucgacguggccggcgacuacaccggcaccauccaguggaccagccagcccagcaacgugacccccgugcccgacgugaacuucuggaccaucccccaguacggcagcaaccuggccgaggccagccagcuggcccccgugguguacccccccggcuucggcgaggccaucguguacuucaugagccccauccccggccccaacaccgcccacaagcccaaccuggugcccugccugcugccccaggaguucgugacccacuucgugagcgagcaggcccccagcaugggcgaggccgcccuggugcacuacguggaccccgacaccaacagaaaccugggcgaguucaagcuguaccccgagggcuucaucaccugcgugcccaacggcaccggcccccagcagcugccccugaacggcguguucguguucgccagcugggugagcagauucuaccagcugaagcccgugggcaccgccagcagcgccagaggcagacugggcgugagaagauga

SEQ ID NO: 22663 - RNA, 1635 nt, Artificial Sequence
  derived and/or modified sequence opt4 from VP1__Norovirus__AFN06736
augaugauggccagcaaggacgcccccaccaacauggacggcaccagcggcgccggccagcuggugcccgaggccaacaccgccgagcccaucagcauggaccccguggccggcgccgccaccgccguggccaccgccggccagaucaacaugaucgaccccuggaucaugagcaacuucgugcaggccccccagggcgaguucaccgugagccccaacaacacccccggcgacgugcuguucgaccugcagcugggcccccagcugaaccccuuccuggcccaccuggcccagauguacaacggcugggugggcaacaugagagugaaggugcugcuggccggcaacgccuucaccgccggcaagaucaucaucagcugcaucccccccggcuucaccagccagaacaucagcaucgcccagaugaccauguucccccacgugaucgccgacgugagagugcuggagcccaucgagaucccccuggaggacgugagaaacgugcuguuccacaccaacgacaacagacccaccaugagacuggugugcaugcuguacaccccccugagagccaacggcagcagcagcggcaccgaccccuucgugaucgccggcagagugcugaccugccccgacagcaacuucagcuuccuguuccuggugccccccaacguggagcagaagaccagacccuucagcgugcccaacaucccccugaacacccugagcaacagcagagugcccagccugaucaagagcaugaccaucagcagagaccagaaccagaucauccaguuccagaacggcagagugacccuggacggccagcugcagggcaccacccccaccagcgugagccagcugugcaagaucagaggcaccaccuaccacgccaccggcggcaacggcaucaaccugaccgagcugaacggcgagcccuaccacgccuucgagagccccgcccccaucggcuuccccgaccugggcggcugcgacuggcaccugaccgccacccccacccaggccuucaacgacggcgccaagguggugagacugagcgugacccagggcgccgccuucgccccccaccugggcaccauccacuacaccaccaccgaccacgacuacgaccccaacaccagcaucaucugcacccuggacuggcugagccagaccaccggccagaacaacguggaccccuggcagauccccaccuacggcagcacccugaccgaggccgcccagcuggccccccccaucuucccccccggcuucggcgagacccugguguucuuccugagcgacuuccccaucagcaacggcaagaacggccugagcgugcccugcacccugccccaggaguucgugacccacuucgugaacgagcaggcccccaucagaggcgaggccgcccugcugcacuacguggaccccgacacccacagaaaccugggcgaguucaagcuguaccccgagggcuucaugaccugcgugcccaacaccagcggcggcggcccccagacccugcccaucaacggcguguucguguucgugagcugggugagcagauucuaccagcugaagcccgugggcaccgccggcgccgccagaagacugggcaucagaagaagcuga

SEQ ID NO: 22664 - RNA, 1635 nt, Artificial Sequence
  derived and/or modified sequence opt4 from VP1__Norovirus__AFN06738
augaugauggccagcaaggacgcccccaccaacauggacggcaccagcggcgccggccagcuggugcccgaggccaacaccgccgagcccaucagcauggagcccguggccggcgccgccaccgccgccgccaccgccggccaggugaacaugaucgaccccuggaucaugaacaacuacgugcaggccccccagggcgaguucaccaucagccccaacaacacccccggcgacauccuguucgaccugcagcugggcccccaccugaaccccuuccugagccaccuggcccagauguacaacggcugggugggcaacaugaaggugaaggugcugcuggccggcaacgccuucaccgccggcaagaucaucaucagcugcaucccccccggcuucgccagccagaacaucagcaucgcccaggccaccauguucccccacgugaucgccgacgugagagugcuggagcccaucgaggugccccuggaggacgugagaaacgugcuguuccacaacaacgacaacacccccaccaugagacuggugugcaugcuguacaccccccugagagccagcggcagcagcagcggcaccgaccccuucgugaucgccggcagagugcugaccugccccagccccgacuucagcuuccuguuccuggugccccccaacguggagcagaagaccaagcccuucagcgugcccaaccugccccugaacgugcugagcaacagcagagugcccagccugaucaaguucaugauggugagccaggaccacggccagauggugcaguuccagaacggcagagugacccuggacggccagcugcagggcaccacccccaccagcgccagccagcugugcaagaugagaggcaccguguaccacgccagcggcggccagggccugaaccugaccgagaucgacggcacccccuaccacgccuucgagagccccgcccccaucggcuuccccgaccugggcgacagcgacuggcacaucaacgccagccccgccaccaccuucaacaccggcgagagcgugaagagacuggacauggagcagggcagcagcuucgccccccaccugggcaccgugcacuacaccaacgccgacuacgacgccaacaccgaccugaucugcagccuggaguggcugagcccccccagcggcggcacccccaacaaggugaaccccugggccauccccagauacggcagcacccugaccgaggccgcccagcuggccccccccaucuacccccccggcuucggcgaggccaucguguucuucaugagcgacuuccccaucgccaacggccaggacggccugaaggugcccugcaccaucccccaggaguucgugacccacuucgugaacgagcaggcccccaccagaggcgaggccgcccugcugcacuacguggaccccgacacccacagaaaccugggcgaguucaagcuguaccccgagggcuucaugaccugcgugcccaacagcagcggcagcggcccccagacccugcccaucaacggcguguucaccuucgugagcugggugagcagauucuaccagcugaagcccgugggcaccaccggccccgugagaagacugggcaucagaagaagcuga

SEQ ID NO: 22665 - RNA, 1635 nt, Artificial Sequence
  derived and/or modified sequence opt4 from VP1__Norovirus__AFN06739
augaugauggccagcaaggacgcccccaccaacauggacggcaccagcggcgccggccagcuggugcccgaggccaacaccgccgagcccaucagcauggagcccguggccggcgccgccaccgccgccgccaccgccggccaggugaacaugaucgaccccuggaucaugaacaacuacgugcaggccccccagggcgaguucaccaucagccccaacaacacccccggcgacauccuguucgaccugcagcugggcccccaccugaaccccuuccugagccaccuggcccagauguacaacggcugggugggcaacaugaaggugaaggugcugcuggccggcaacgccuucaccgccggcaagaucaucaucagcugcaucccccccggcuucgccagccagaacaucagcaucgcccaggccaccauguucccccacgugaucgccgacgugagagugcuggagcccaucgaggugccccuggaggacgugagaaacgugcuguuccacaacaacgacaacacccccaccaugagacuggugugcaugcuguacaccccccugagagccagcggcagcagcagcggcaccgaccccuucgugaucgccggcagagugcugaccugccccagccccgacuucagcuuccuguuccuggugccccccaacguggagcagaagaccaagcccuucagcgugcccaaccugccccugaacgugcugagcaacagcagagugcccagccugaucaagagcaugauggugagccaggaccacggccagauggugcaguuccagaacggcagagugacccuggacggccagcugcagggcaccacccccaccagcgccagccagcugugcaagaugagaggcaccguguaccacgccagcggcggccagggccugaaccugaccgagaucgacggcacccccuaccacgccuucgagagccccgcccccaucggcuuccccgacaucggcgacagcgacuggcacaucaacgccagccccgccaccaccuucgacagcggcgagagcaucaagagacuggacauggagcagggcagcagcuucgccccccaccugggcaccgugcacuacaccaacgccgacuaccccgccaacaccgaccugaucugcagccuggaguggcugagcccccccagcggcggcacccccaacaaggugaaccccuggaccauccccagauacggcagcacccugaccgaggccgcccagcuggccccccccaucuacccccccggcuucggcgaggccaucguguucuucaugagcgacuuccccaucgccaacggccaggacggccugaaggugcccugcaccaucccccaggaguucgugacccacuucgugaacgagcaggcccccaccagaggcgaggccgcccugcugcacuacguggaccccgacacccacagaaaccugggcgaguucaagcuguaccccgagggcuucaugaccugcgugcccaacagcagcggcagcggcccccagacccugcccaucaacggcguguucaccuucgugagcugggugagcagauucuaccagcugaagcccgugggcaccaccggccccgugagaagacugggcaucagaagaagcuga

SEQ ID NO: 22666 - RNA, 1623 nt, Artificial Sequence
  derived and/or modified sequence opt4 from VP1__Norovirus__AFV08771
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcaccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgacgccaaccagaacaccaaguucacccccgugggcgugauccaggacggcaacaccgcccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22667 - RNA, 1623 nt, Artificial Sequence; identical to SEQ ID NO: 22264
  derived and/or modified sequence opt4 from VP1__Norovirus__AFV08774

SEQ ID NO: 22668 - RNA, 1623 nt, Artificial Sequence
  derived and/or modified sequence opt4 from VP1__Norovirus__AFV08777
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaagcaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccagcuuccccaucgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcaacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccaagaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22669 - RNA, 1623 nt, Artificial Sequence
  derived and/or modified sequence opt4 from VP1__Norovirus__AFV08780
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccacccagaacuggaacagcuacgaccccaccgaggagauccccgccccccugggcacccccgacuucgugggcaagauccagggcgugcugacccagaccaccagagccgacggcagcaccagaggccacaaggccaccguguacaccggcagcgccgacuucgcccccaagcugggcagagugcaguucgccaccgacaccgaccacgacuucgacgccaaccagaacaccaaguucacccccgugggcgugauccaggacggcgacaccgcccacagaaacgagccccagcagugggugcugcccagcuacagcggcagaaacagccacaacgugcaccuggcccccaccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22670 - RNA, 1623 nt, Artificial Sequence
  derived and/or modified sequence opt4 from VP1__Norovirus__AFV08783
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcaugcugacccagaccaccagaaccgacggcagcaccagaggccacaaggccaccguguacaccggcagcgccgacuucagccccaagcugggcagagugcaguucgccaccgacaccgacaacgacuucgugaccaaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagaccggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22671 - RNA, 1623 nt, Artificial Sequence
  derived and/or modified sequence opt4 from VP1__Norovirus__AFV08786
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22672 - RNA, 1623 nt, Artificial Sequence
  derived and/or modified sequence opt4 from VP1__Norovirus__AFV08789
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucggcaccgacaccgagaacgacuucgagacccaccagaacaccaaguucacccccgugggcgugauccaggacggcggcaccacccacagaaacgagccccagcagugggugcugcccagcuacagcggcagagacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22673 - RNA, 1623 nt, Artificial Sequence
  derived and/or modified sequence opt4 from VP1__Norovirus__AFV08792
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgacgagauccccgccccccugggcacccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagugguguga

SEQ ID NO: 22674 - RNA, 1623 nt, Artificial Sequence
  derived and/or modified sequence opt4 from VP1__Norovirus__AFV08795
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacgacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgacagagacuucgaggccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagccguguga

SEQ ID NO: 22675 - RNA, 1623 nt, Artificial Sequence
  derived and/or modified sequence opt4 from VP1__Norovirus__AFX95940
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgacagagacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22676 - RNA, 1620 nt, Artificial Sequence
  derived and/or modified sequence opt4 from VP1__Norovirus__AFZ84663
augaagauggccagcaacgacgccagccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaccuucagaggcgacgugacccacaucgccggcagccacgacuacaccaugaaccuggccagccagaacuggaacaacuacgaccccaccgaggagauccccgccccccugggcacccccgacuucgugggcaagauccagggcaugcugacccagaccaccagagaggacggcagcaccagagcccacaaggccaccgugagcaccggcagcgugcacuucacccccaagcugggcagcgugcaguacaccaccgacaccaacaacgacuuccagaccggccagaacaccaaguucacccccgugggcgugauccaggacggcaacaaccaccagaacgagccccagcagugggugcugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcgccggcagaagaagagugcuguga

SEQ ID NO: 22677 - RNA, 1623 nt, Artificial Sequence
  derived and/or modified sequence opt4 from VP1__Norovirus__AGG37871
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgagguggcccugcugagauucgugaaccccgacaccggcagagugcuguucgagugcaagcugcacaagagcggcuacgugaccguggcccacaccggccaguacgaccuggugaucccccccaacggcuacuucagauucgacagcugggugaaccaguucuacacccuggcccccaugggcaacggcaccggcagaagaagagccguguga

SEQ ID NO: 22678 - RNA, 1623 nt, Artificial Sequence
  derived and/or modified sequence opt4 from VP1__Norovirus__AGI96383
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagccacaacuacaccaugaaccuggccagccagaacuggaacagcuacgaccccaccgaggagauccccgccccccugggcacccccgacuucgugggcaagauccagggcgugcugacccagaccaccagcaccaacggcagcaccagaggccacaaggccaccguguacaccggcagcgccgacuucagccccaagcugggcagagugcaguucagcaccgacaccaacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22679 - RNA, 1623 nt, Artificial Sequence
  derived and/or modified sequence opt4 from VP1__Norovirus__AGI99552
augaagauggccagcagcgacgccaaccccagcgacggcagcgccgccaaccuggugcccaaggugaacaacgaggugauggcccuggagcccguggugggcgccgccaucgccgcccccguggccggccagcagaacgugaucgaccccuggaucaagaacaacuucgugcaggcccccggcggcgaguucaccgugagccccaagaacgcccccggcgagauccuguggagcgccccccugggccccgaccugaaccccuaccugagccaccuggccaagauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaccaucggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagaccccuguga

SEQ ID NO: 22680 - RNA, 1623 nt, Artificial Sequence
  derived and/or modified sequence opt4 from VP1__Norovirus__AGI99553
augaagauggccagcagcgacgccaacccccccgacggcagcgccgccaaccuggugcccaaggugaacaacgaggugauggcccuggagcccguggugggcgccgccaucgccgcccccguggccggccagcagaacgugaucgaccccuggaucaagaacaacuucgugcaggcccccggcggcgaguucaccgugagccccaagaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagagacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagaccccuguga

SEQ ID NO: 22681 - RNA, 1623 nt, Artificial Sequence
  derived and/or modified sequence opt4 from VP1__Norovirus__AGI99554
augaagauggccagcagcgacgccaaccccagcgacggcagcgccgccaaccuggugcccaaggugaacaacgaggugauggcccuggagcccguggugggcgccgccaucgccgcccccguggccggccagcagaacgugaucgaccccuggaucaagaacaacuucgugcaggcccccggcggcgaguucaccgugagccccaagaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgacagagacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagaccccuguga

SEQ ID NO: 22682 - RNA, 1623 nt, Artificial Sequence
  derived and/or modified sequence opt4 from VP1__Norovirus__AGI99555
augaagauggccagcagcgacgccaaccccagcgacggcagcgccgccaaccuggugcccaaggugaacaacgaggugauggcccuggagcccguggugggcgccgccaucgccgcccccguggccggccagcagaacgugaucgaccccuggaucaagaacaacuucgugcaggcccccggcggcgaguucaccgugagccccaagaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagaccccuguga

SEQ ID NO: 22683 - RNA, 1623 nt, Artificial Sequence
  derived and/or modified sequence opt4 from VP1__Norovirus__AGK25882
augaagauggccagcaacgacgccagccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagaagacuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccuacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcaugcugacccagaccaccaagggcgacggcagcaccagaggccacaaggccaccguguacaccggcagcgcccccuucacccccaagcugggcagcgugcaguucgagaccgacaccgagaacgacuucgagacccaccagaacaucaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccugaucaucccccccaacggcuacuucagauucgacagcugggugaaccaguucuacacccuggcccccaugggcaacggcaccggcagaagaagagcccuguga

SEQ ID NO: 22684 - RNA, 1623 nt, Artificial Sequence
  derived and/or modified sequence opt4 from VP1__Norovirus__AGK25884
augaagauggccagcaacgacgccagccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcaugcugacccagaccgccaagggcgacggcagcaccagaggccacaaggccaccguguacaccggcagcgcccccuucacccccaagcugggcagcgugcaguucgagaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcugccccgacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccugaucaucccccccaacggcuacuucagauucgacagcugggugaaccaguucuacacccuggcccccaugggcaacggcaccggcagaagaagagcccuguga

SEQ ID NO: 22685 - RNA, 1623 nt, Artificial Sequence
  derived and/or modified sequence opt4 from VP1__Norovirus__AGK25887
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacaucacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccgugcacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagccguguga

SEQ ID NO: 22686 - RNA, 1623 nt, Artificial Sequence
  derived and/or modified sequence opt4 from VP1__Norovirus__AGK25890
augaagauggccagcagcgacgccaaccccagcgacggcagcgccgccaaccuggugcccgaggugaacaacgaggugaucgcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacaucgcccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaaccugcacaagagcggcuacgugaccguggcccacaccggccagcacgaccuggugaucccccccaacggcuacuucagauucgacagcugggugaaccaguucuacacccuggcccccaugggcaacggcaccggcagaagaagagccguguga

SEQ ID NO: 22687 - RNA, 1623 nt, Artificial Sequence; identical to SEQ ID NO: 22072
  derived and/or modified sequence opt4 from VP1__Norovirus__AGK25892

SEQ ID NO: 22688 - RNA, 1623 nt, Artificial Sequence
  derived and/or modified sequence opt4 from VP1__Norovirus__AGK25898
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcuggacaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcaugcugacccagaccaccaagggcgacggcagcaccagaggccacaaggccaccguguacaccggcagcgcccccuucacccccaagcugggcagcgugcaguucgagaccgacaccgagaacgacuucgagacccaccagaacaccaaguucacccccgugggcgugauccaggacggcggcaccacccacagaaacgagccccagcagugggugcugcccagcuacagcggcagaaacgugcccaacgcccaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccgccgcccacaccggccagcacgaccuggugaucccccccaacggcuacuucagauucgacagcugggugaaccaguucuacacccuggcccccaugggcaacggcaccggcagaagaagagcccuguga

SEQ ID NO: 22689 - RNA, 1623 nt, Artificial Sequence
  derived and/or modified sequence opt4 from VP1__Norovirus__AGK25900
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaacagcgccagccugaacuggaacaacuacgaccccaccgaggagauccccgccccccugggcacccccgacuucgugggcaagauccagggcaugcugacccagaccaccaagggcgacggcagcaccagaggccacaaggccaccguguacaccggcagcgcccccuucacccccaagcugggcagcgugcaguucgagaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22690 - RNA, 1623 nt, Artificial Sequence
  derived and/or modified sequence opt4 from VP1__Norovirus__AGK25902
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgccagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcaugcugacccagaccaccaagggcgacggcagcaccagaggccacaaggccaccguguacaccggcagcgcccccuucacccccaagcugggcagcgugcaguucgagaccgacaccgagaacgacuucgagacccaccagaacaccaaguucacccccgugggcgugauccaggacggcggcaccgcccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22691 - RNA, 1623 nt, Artificial Sequence
  derived and/or modified sequence opt4 from VP1__Norovirus__AGK25905
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgcccaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccgagaacgccuucaccgccggcaagaucaucuucgccgccgugccccccaacuuccccaccgagggccugagccccagcagagugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaccaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgugcccaccgaggagauccccgccccccugggcacccccgacuucgugggcaaggugcagggcaugcugacccagaccaccaagggcgacggcagcaccagaggccacaaggccaccguguacaccggcagcgcccccuucacccccaagcugggcagcgugcaguucgagaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22692 - RNA, 1623 nt, Artificial Sequence
  derived and/or modified sequence opt4 from VP1__Norovirus__AGK25908
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccaccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucgagaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22693 - RNA, 1623 nt, Artificial Sequence
  derived and/or modified sequence opt4 from VP1__Norovirus__AGK25910
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugcccagcaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacacccugcugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcaugcugacccagaccaccagaaccgacggcagcaccagaggccacaaggccaccauguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagacccaccaugcccggcugcagcggcuaccccaacauggaccuggacagacugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagugguguga

SEQ ID NO: 22694 - RNA, 1623 nt, Artificial Sequence
  derived and/or modified sequence opt4 from VP1__Norovirus__AGK25912
augaagauggccagcaacgacgccaaccccagcgacggcagcgccgccaaccuggugcccgagguggacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggccccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcaugcugacccagaccaccaagggcgacggcagcaccagaggccacaaggccaccguguacaccggcagcgcccccuucacccccaagcugggcagcgugcaguucgagaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22695 - RNA, 1623 nt, Artificial Sequence
  derived and/or modified sequence opt4 from VP1__Norovirus__AGK25915
augaagauggccagcaacgacgccaaccccagcgacggcagcgccgugaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgccagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacguggcccacaucgccggcagcagaaacuacaccaugaaccuggccagccugaacuggaacaacuacgaccccaccgaggagauccccgccccccugggcacccccgacuucgugggcaagauccagggcaugcugacccagaccaccaagggcgacggcagcaccagaggccacaaggccaccguguacaccggcagcgcccccuucacccccaagcugggcagcgugcaguucgagaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcugcuguucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccagcggcuacuucagauucgacagcugggugaaccaguucuacacccuggcccccaugggcaacggcaccggcagaagaagagcccuguga

SEQ ID NO: 22696 - RNA, 1623 nt, Artificial Sequence
  derived and/or modified sequence opt4 from VP1__Norovirus__AGK25917
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcggcuuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaaggugcagggcgugcugacccagaccaccaagggcgacggcagcaccagaggccacaaggccaccguguacaccggcagcgcccccuucacccccaagcugggcagcgugcaguucgagaccgacaccgagaacgacuucgagacccaccagaacaccaaguucacccccgugggcgugauccaggacggcggcaccgcccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagagagaccuggugaucccccccaacggcuacuucagauucgacagcugggugaaccaguucuacacccuggcccccaugggcaacggcaccggcagaagaagagcccuguga

SEQ ID NO: 22697 - RNA, 1623 nt, Artificial Sequence
  derived and/or modified sequence opt4 from VP1__Norovirus__AGK25919
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagacccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccacagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcagcggcaccggcagaagaagagccguguga

SEQ ID NO: 22698 - RNA, 1623 nt, Artificial Sequence
  derived and/or modified sequence opt4 from VP1__Norovirus__AGK25921
augaagauggccagcagcgacgccaaccccagcgacggcagcgccgccaaccuggugcccgaggugaacaacgaggugauggcccuggagcccguggccggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacgccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagccguguga

SEQ ID NO: 22699 - RNA, 1623 nt, Artificial Sequence
  derived and/or modified sequence opt4 from VP1__Norovirus__AGK25924
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcugagcaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagccguguga

SEQ ID NO: 22700 - RNA, 1623 nt, Artificial Sequence
  derived and/or modified sequence opt4 from VP1__Norovirus__AGK25927
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacgccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccaacaccggcagagugcuguucgagugcaagcugcacaagagcggcuacgugaccguggcccacaccggccagcacgaccuggugaucccccccaacgacuacuucagauucgacagcugggugaaccaguucuacacccuggcccccaugggcaacggcaccggcagaagaagagccguguga

SEQ ID NO: 22701 - RNA, 1623 nt, Artificial Sequence
  derived and/or modified sequence opt4 from VP1__Norovirus__AGK25930
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugggcaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagccguguga

SEQ ID NO: 22702 - RNA, 1623 nt, Artificial Sequence
  derived and/or modified sequence opt4 from VP1__Norovirus__AGS08025
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccaagaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22703 - RNA, 1623 nt, Artificial Sequence; identical to SEQ ID NO: 22264
  derived and/or modified sequence opt4 from VP1__Norovirus__AGS08026

SEQ ID NO: 22704 - RNA, 1623 nt, Artificial Sequence
  derived and/or modified sequence opt4 from VP1__Norovirus__AGS08027
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagccacaacuacaccaugaaccuggccagccagaacuggaacagcuacgaccccaccgaggagauccccgccccccugggcacccccgacuucgugggcaagauccagggcgugcugacccagaccaccagcgccaacggcagcaccagaggccacaaggccaccguguacaccggcagcgccgacuucagccccaagcugggcagagugcaguucgccaccgacaccaacaacgacuucgagaccaaccagaacaccaaguucacccccgugggcgugauccaggacggcaacaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22705 - RNA, 1623 nt, Artificial Sequence
  derived and/or modified sequence opt4 from VP1__Norovirus__AGS08028
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggagaccgcccccgcccagagcgacguggcccugcugagauucgugaaccccgacaccggcagagugcuguucgagugcaagcugcacaagagcugcuacgugaccguggcccacaccggccagcacgaccuggugaucccccccaacggcuacuucagauucgacagcugggugaaccaguucuacacccuggcccccaugggcaacggcaccggcagaagaagagccguguga

SEQ ID NO: 22706 - RNA, 1623 nt, Artificial Sequence; identical to SEQ ID NO: 22112
  derived and/or modified sequence opt4 from VP1__Norovirus__AGS08029

SEQ ID NO: 22707 - RNA, 1623 nt, Artificial Sequence; identical to SEQ ID NO: 22112
  derived and/or modified sequence opt4 from VP1__Norovirus__AGS08030

SEQ ID NO: 22708 - RNA, 1623 nt, Artificial Sequence; identical to SEQ ID NO: 22112
  derived and/or modified sequence opt4 from VP1__Norovirus__AGS08031

SEQ ID NO: 22709 - RNA, 1623 nt, Artificial Sequence; identical to SEQ ID NO: 22072
  derived and/or modified sequence opt4 from VP1__Norovirus__AGS08032

SEQ ID NO: 22710 - RNA, 1623 nt, Artificial Sequence
  derived and/or modified sequence opt4 from VP1__Norovirus__AGS08033
augaagauggccagcagcgacgccaaccccagcgacggcagcguggccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagccguguga

SEQ ID NO: 22711 - RNA, 1623 nt, Artificial Sequence
  derived and/or modified sequence opt4 from VP1__Norovirus__AGS08035
augaagauggccagcagcgacgccaaccccagcgacggcagcaccgccagccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacagcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagccacaacuacaccaugaaccuggccagccagaacuggaacagcuacgaccccaccgaggagauccccgccccccugggcacccccgacuucgugggcaagauccagggcgugcugacccagaccaccagaaucaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22712 - RNA, 1623 nt, Artificial Sequence; identical to SEQ ID NO: 22264
  derived and/or modified sequence opt4 from VP1__Norovirus__AGS08036

SEQ ID NO: 22713 - RNA, 1623 nt, Artificial Sequence; identical to SEQ ID NO: 22112
  derived and/or modified sequence opt4 from VP1__Norovirus__AGS08037

SEQ ID NO: 22714 - RNA, 1623 nt, Artificial Sequence
  derived and/or modified sequence opt4 from VP1__Norovirus__AGS08038
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgacgccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagccguguga

SEQ ID NO: 22715 - RNA, 1623 nt, Artificial Sequence; identical to SEQ ID NO: 22112
  derived and/or modified sequence opt4 from VP1__Norovirus__AGS08040

SEQ ID NO: 22716 - RNA, 1623 nt, Artificial Sequence; identical to SEQ ID NO: 22264
  derived and/or modified sequence opt4 from VP1__Norovirus__AGS08041

SEQ ID NO: 22717 - RNA, 1623 nt, Artificial Sequence; identical to SEQ ID NO: 22072
  derived and/or modified sequence opt4 from VP1__Norovirus__AGS08042

SEQ ID NO: 22718 - RNA, 1623 nt, Artificial Sequence
  derived and/or modified sequence opt4 from VP1__Norovirus__AGS08043
augaagauggccagcagcgacgccaaccccagcgacggcagcaccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacagcgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagccacaacuacaccaugaaccuggccagccagaacuggaacagcuacgaccccaccgaggagauccccgccccccugggcacccccgacuucgugggcaagauccagggcgugcugacccagaccaccagcaccaacggcagcaccagaggccacaaggccaccguguacaccggcagcgccgacuucagccccaagcugggcagagugcaguucgccaccgacaccaacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacaucaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22719 - RNA, 1623 nt, Artificial Sequence
  derived and/or modified sequence opt4 from VP1__Norovirus__AGS08044
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagccacaacuacaccaugaaccuggccagccagaacuggaacagcuacgaccccaccgaggagauccccgccccccugggcacccccgacuucgugggcaagauccagggcgugcugacccagaccaccagcaccaacggcagcaccagaggccacaaggccaccguguacaccggcagcgccgacuucagccccaagcugggcagagugcaguucgccaccgacaccaacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22720 - RNA, 1623 nt, Artificial Sequence
  derived and/or modified sequence opt4 from VP1__Norovirus__AGS08045
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccgugccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22721 - RNA, 1623 nt, Artificial Sequence
  derived and/or modified sequence opt4 from VP1__Norovirus__AGS08047
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacagcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgugaccaaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22722 - RNA, 1623 nt, Artificial Sequence; identical to SEQ ID NO: 22264
  derived and/or modified sequence opt4 from VP1__Norovirus__AGS08048

SEQ ID NO: 22723 - RNA, 1623 nt, Artificial Sequence
  derived and/or modified sequence opt4 from VP1__Norovirus__AGS08050
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22724 - RNA, 1623 nt, Artificial Sequence
  derived and/or modified sequence opt4 from VP1__Norovirus__AGS08051
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcgccuucagaggcgacgugacccacaucagcggcagcagaaacuacaccaugaaccuggccagccagaacuggaacagcuacgaccccaccgaggagauccccgccccccugggcacccccgacuucgugggcaagauccagggcaugcugacccagaccaccagaaccgacggcagcaccagaggccacaaggccaccguguacaccggcagcgccgacuucagccccaagcugggcagagugcaguucgccaccgacaccgacaacgacuucgugaccaaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22725 - RNA, 1623 nt, Artificial Sequence
  derived and/or modified sequence opt4 from VP1__Norovirus__AGS08052
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucggcaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22726 - RNA, 1623 nt, Artificial Sequence
  derived and/or modified sequence opt4 from VP1__Norovirus__AGS08054
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucguggccgaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22727 - RNA, 1623 nt, Artificial Sequence
  derived and/or modified sequence opt4 from VP1__Norovirus__AGS08056
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgacagagacuucgaggccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22728 - RNA, 1623 nt, Artificial Sequence
  derived and/or modified sequence opt4 from VP1__Norovirus__AGS08057
augaagauggccagcagcgacgcccaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagagccgacggcagcaccagaggccacaaggccaccguguacaccggcagcgccgacuucagccccaagcugggcagagugcaguucgccaccgacaccgacaacgacuucguggccaaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22729 - RNA, 1623 nt, Artificial Sequence
  derived and/or modified sequence opt4 from VP1__Norovirus__AGS08058
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagccguguga

SEQ ID NO: 22730 - RNA, 1623 nt, Artificial Sequence
  derived and/or modified sequence opt4 from VP1__Norovirus__AGS08059
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggaacgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgccaccguggcccacaccggccagcacgaccuggugaucccccccaacggcuacuucagauucgacagcugggugaaccaguucuacacccuggcccccaugggcaacggcaccggcagaagaagagccguguga

SEQ ID NO: 22731 - RNA, 1623 nt, Artificial Sequence
  derived and/or modified sequence opt4 from VP1__Norovirus__AGS08060
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22732 - RNA, 1623 nt, Artificial Sequence; identical to SEQ ID NO: 22072
  derived and/or modified sequence opt4 from VP1__Norovirus__AGS08061

SEQ ID NO: 22733 - RNA, 1623 nt, Artificial Sequence; identical to SEQ ID NO: 22727
  derived and/or modified sequence opt4 from VP1__Norovirus__AGS08062

SEQ ID NO: 22734 - RNA, 1623 nt, Artificial Sequence; identical to SEQ ID NO: 22719
  derived and/or modified sequence opt4 from VP1__Norovirus__AGS08063

SEQ ID NO: 22735 - RNA, 1623 nt, Artificial Sequence; identical to SEQ ID NO: 22264
  derived and/or modified sequence opt4 from VP1__Norovirus__AGS08064

SEQ ID NO: 22736 - RNA, 1623 nt, Artificial Sequence; identical to SEQ ID NO: 22112
  derived and/or modified sequence opt4 from VP1__Norovirus__AGS08065

SEQ ID NO: 22737 - RNA, 1623 nt, Artificial Sequence; identical to SEQ ID NO: 22719
  derived and/or modified sequence opt4 from VP1__Norovirus__AGS08066

SEQ ID NO: 22738 - RNA, 1623 nt, Artificial Sequence; identical to SEQ ID NO: 22264
  derived and/or modified sequence opt4 from VP1__Norovirus__AGS08067

SEQ ID NO: 22739 - RNA, 1623 nt, Artificial Sequence
  derived and/or modified sequence opt4 from VP1__Norovirus__AGS08068
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcagcgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgugaccaaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22740 - RNA, 1623 nt, Artificial Sequence
  derived and/or modified sequence opt4 from VP1__Norovirus__AGS08069
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22741 - RNA, 1623 nt, Artificial Sequence
  derived and/or modified sequence opt4 from VP1__Norovirus__AGS08070
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucggcgugcaggugauccuggccggcaacgccuucaccgccggcaaggugaucuucgccgccgugccccccaacuuccccaccgagggccugagccccagccaggugaccauguucccccacaucguggugaacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagacccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccugaccggccagcacgaccuggugaucccccccaacggcuacuucagauucgacagcugggugaaccaguucuacacccuggcccccaugggcaacggcaccggcagaagaagagccguguga

SEQ ID NO: 22742 - RNA, 1623 nt, Artificial Sequence; identical to SEQ ID NO: 22727
  derived and/or modified sequence opt4 from VP1__Norovirus__AGS08071

SEQ ID NO: 22743 - RNA, 1623 nt, Artificial Sequence; identical to SEQ ID NO: 22112
  derived and/or modified sequence opt4 from VP1__Norovirus__AGS08072

SEQ ID NO: 22744 - RNA, 1623 nt, Artificial Sequence; identical to SEQ ID NO: 22635
  derived and/or modified sequence opt4 from VP1__Norovirus__AGS08073

SEQ ID NO: 22745 - RNA, 1623 nt, Artificial Sequence; identical to SEQ ID NO: 22719
  derived and/or modified sequence opt4 from VP1__Norovirus__AGS08074

SEQ ID NO: 22746 - RNA, 1623 nt, Artificial Sequence; identical to SEQ ID NO: 22264
  derived and/or modified sequence opt4 from VP1__Norovirus__AGS08076

SEQ ID NO: 22747 - RNA, 1623 nt, Artificial Sequence; identical to SEQ ID NO: 22264
  derived and/or modified sequence opt4 from VP1__Norovirus__AGS08079

SEQ ID NO: 22748 - RNA, 1623 nt, Artificial Sequence; identical to SEQ ID NO: 22719
  derived and/or modified sequence opt4 from VP1__Norovirus__AGS08080

SEQ ID NO: 22749 - RNA, 1623 nt, Artificial Sequence
  derived and/or modified sequence opt4 from VP1__Norovirus__AGS08081
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagccacaacuacaccaugaaccuggccagccagaacuggaacagcuacgaccccaccgaggagauccccgccccccugggcacccccgacuucgugggcaagauccagggcgugcugacccagaccaccagcaccaacggcagcaccagaggccacaaggccaccguguacaccggcagcgccgacuucagccccaagcugggcagagugcaguucgugaccgacaccaacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22750 - RNA, 1623 nt, Artificial Sequence
  derived and/or modified sequence opt4 from VP1__Norovirus__AGS08082
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucacccccaagcugggcagagugcaguucgccaccgacaccgacaacgacuucgugaccaaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22751 - RNA, 1623 nt, Artificial Sequence; identical to SEQ ID NO: 22264
  derived and/or modified sequence opt4 from VP1__Norovirus__AGS08083

SEQ ID NO: 22752 - RNA, 1623 nt, Artificial Sequence
  derived and/or modified sequence opt4 from VP1__Norovirus__AGS08084
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcuacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagccacaacuacaccaugaaccuggccagccagaacuggaacagcuacgaccccaccgaggagauccccgccccccugggcacccccgacuucgugggcaagauccagggcgugcugacccagaccaccaagaccaacggcagcaccagaggccacaaggccaccguguacaccggcagcgccgacuucagccccaagcugggcagagugcaguucgccaccgacaccaacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggccuacaccggccagcacgaccuggugaucccccccaacggcuacuucagauucgacagcugggugaaccaguucuacacccuggcccccaugggcaacggcaccggcagaagaagagcccuguga

SEQ ID NO: 22753 - RNA, 1623 nt, Artificial Sequence
  derived and/or modified sequence opt4 from VP1__Norovirus__AGS08085
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgccaccguggcccacaccggccagcacgaccuggugaucccccccaacggcuacuucagauucgacagcugggugaaccaguucuacacccuggcccccaugggcaacggcaccggcagaagaagagccguguga

SEQ ID NO: 22754 - RNA, 1623 nt, Artificial Sequence; identical to SEQ ID NO: 22719
  derived and/or modified sequence opt4 from VP1__Norovirus__AGS08086

SEQ ID NO: 22755 - RNA, 1623 nt, Artificial Sequence
  derived and/or modified sequence opt4 from VP1__Norovirus__AGS08087
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccagcaccauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgugaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22756 - RNA, 1623 nt, Artificial Sequence; identical to SEQ ID NO: 22719
  derived and/or modified sequence opt4 from VP1__Norovirus__AGS08088

SEQ ID NO: 22757 - RNA, 1623 nt, Artificial Sequence; identical to SEQ ID NO: 22072
  derived and/or modified sequence opt4 from VP1__Norovirus__AGS08089

SEQ ID NO: 22758 - RNA, 1623 nt, Artificial Sequence; identical to SEQ ID NO: 22264
  derived and/or modified sequence opt4 from VP1__Norovirus__AGS08090

SEQ ID NO: 22759 - RNA, 1623 nt, Artificial Sequence
  derived and/or modified sequence opt4 from VP1__Norovirus__AGS08091
augaagauggccagcagcgacgccaaccccaccgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagacccccgccccccugggcacccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagugguguga

SEQ ID NO: 22760 - RNA, 1623 nt, Artificial Sequence; identical to SEQ ID NO: 22264
  derived and/or modified sequence opt4 from VP1__Norovirus__AGS08092

SEQ ID NO: 22761 - RNA, 1623 nt, Artificial Sequence; identical to SEQ ID NO: 22719
  derived and/or modified sequence opt4 from VP1__Norovirus__AGS08093

SEQ ID NO: 22762 - RNA, 1623 nt, Artificial Sequence; identical to SEQ ID NO: 22112
  derived and/or modified sequence opt4 from VP1__Norovirus__AGS08094

SEQ ID NO: 22763 - RNA, 1623 nt, Artificial Sequence; identical to SEQ ID NO: 22112
  derived and/or modified sequence opt4 from VP1__Norovirus__AGS08095

SEQ ID NO: 22764 - RNA, 1623 nt, Artificial Sequence; identical to SEQ ID NO: 22727
  derived and/or modified sequence opt4 from VP1__Norovirus__AGS08096

SEQ ID NO: 22765 - RNA, 1623 nt, Artificial Sequence
  derived and/or modified sequence opt4 from VP1__Norovirus__AGS08097
augaagauggccagcagcgacgccaaccccagcgacggcagcaccgccaaccuggugcccgaggugaacaacgaggugauggcccuggagcccguggugggcgccgccaucgccgcccccguggccggccagcagaacaucaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgugaccaaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22766 - RNA, 1623 nt, Artificial Sequence
  derived and/or modified sequence opt4 from VP1__Norovirus__AGS08098
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagccacaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgugaccaaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22767 - RNA, 1623 nt, Artificial Sequence; identical to SEQ ID NO: 22264
  derived and/or modified sequence opt4 from VP1__Norovirus__AGS08099

SEQ ID NO: 22768 - RNA, 1623 nt, Artificial Sequence
  derived and/or modified sequence opt4 from VP1__Norovirus__AGS08100
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggugagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22769 - RNA, 1623 nt, Artificial Sequence
  derived and/or modified sequence opt4 from VP1__Norovirus__AGS08101
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucaucaccaaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagcccggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22770 - RNA, 1623 nt, Artificial Sequence; identical to SEQ ID NO: 22675
  derived and/or modified sequence opt4 from VP1__Norovirus__AGS08102

SEQ ID NO: 22771 - RNA, 1623 nt, Artificial Sequence
  derived and/or modified sequence opt4 from VP1__Norovirus__AGS08103
augaagauggccagcagcgacgcccaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgugaccaaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22772 - RNA, 1623 nt, Artificial Sequence; identical to SEQ ID NO: 22765
  derived and/or modified sequence opt4 from VP1__Norovirus__AGS08104

SEQ ID NO: 22773 - RNA, 1623 nt, Artificial Sequence; identical to SEQ ID NO: 22731
  derived and/or modified sequence opt4 from VP1__Norovirus__AGS08105

SEQ ID NO: 22774 - RNA, 1623 nt, Artificial Sequence; identical to SEQ ID NO: 22750
  derived and/or modified sequence opt4 from VP1__Norovirus__AGS08106

SEQ ID NO: 22775 - RNA, 1623 nt, Artificial Sequence; identical to SEQ ID NO: 22719
  derived and/or modified sequence opt4 from VP1__Norovirus__AGS08107

SEQ ID NO: 22776 - RNA, 1623 nt, Artificial Sequence
  derived and/or modified sequence opt4 from VP1__Norovirus__AGS08108
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggagcagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgugaccaaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22777 - RNA, 1623 nt, Artificial Sequence
  derived and/or modified sequence opt4 from VP1__Norovirus__AGS08109
augaagauggccagcagcgacgccaaccccagcgacggcagcgccgccaaccuggugcccgaggugaacaacgaggugauggcccuggagcccguggccggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagugguguga

SEQ ID NO: 22778 - RNA, 1623 nt, Artificial Sequence
  derived and/or modified sequence opt4 from VP1__Norovirus__AGS08110
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagccacaacuacaccaugaaccuggccagccagaacuggaacagcuacgaccccaccgaggagauccccgccccccugggcacccccgacuucgugggcaagauccagggcgugcugacccagaccaccagcaccaacggcagcaccagaggccacaaggccaccguguacaccggcagcgccgacuucagccccaagcugggcagagugcaguucgccaccgacaccaacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22779 - RNA, 1623 nt, Artificial Sequence
  derived and/or modified sequence opt4 from VP1__Norovirus__AGS08111
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccaguacgaccuggugaucccccccaacggcuacuucagauucgacagcugggugaaccaguucuacacccuggcccccaugggcaacggcaccggcagaagaagagcccuguga

SEQ ID NO: 22780 - RNA, 1623 nt, Artificial Sequence; identical to SEQ ID NO: 22264
  derived and/or modified sequence opt4 from VP1__Norovirus__AGS08112

SEQ ID NO: 22781 - RNA, 1623 nt, Artificial Sequence
  derived and/or modified sequence opt4 from VP1__Norovirus__AGS08113
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgugaccaaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagagcccuguga

SEQ ID NO: 22782 - RNA, 1623 nt, Artificial Sequence; identical to SEQ ID NO: 22719
  derived and/or modified sequence opt4 from VP1__Norovirus__AGS08114

SEQ ID NO: 22783 - RNA, 1623 nt, Artificial Sequence; identical to SEQ ID NO: 22264
  derived and/or modified sequence opt4 from VP1__Norovirus__AGS08115

SEQ ID NO: 22784 - RNA, 1623 nt, Artificial Sequence; identical to SEQ ID NO: 22710
  derived and/or modified sequence opt4 from VP1__Norovirus__AGS08116

SEQ ID NO: 22785 - RNA, 1623 nt, Artificial Sequence
  derived and/or modified sequence opt4 from VP1__Norovirus__AGS08117
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcaugcugacccagaccaccagaaccgacggcagcaccagaggccacaaggccaccguguacaccggcagcgccgacuucagccccaagcugggcagagugcaguucgccaccgacaccgacaacgacuucgugaccaaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22786 - RNA, 1623 nt, Artificial Sequence; identical to SEQ ID NO: 22719
  derived and/or modified sequence opt4 from VP1__Norovirus__AGS08119

SEQ ID NO: 22787 - RNA, 1623 nt, Artificial Sequence; identical to SEQ ID NO: 22765
  derived and/or modified sequence opt4 from VP1__Norovirus__AGS08120

SEQ ID NO: 22788 - RNA, 1623 nt, Artificial Sequence; identical to SEQ ID NO: 22719
  derived and/or modified sequence opt4 from VP1__Norovirus__AGS08121

SEQ ID NO: 22789 - RNA, 1623 nt, Artificial Sequence
  derived and/or modified sequence opt4 from VP1__Norovirus__AGS08122
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgugaccaaccagaacaccaaguucacccccgugggcgugauccaggacggcaacaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagcccggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22790 - RNA, 1623 nt, Artificial Sequence
  derived and/or modified sequence opt4 from VP1__Norovirus__AGS08124
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacagcgacuucgugaccaaccagaacaccaaguucacccccgugggcgugauccaggacggcagcaccacccccagaaacgagccccagcagugggugcugcccagcuacagcggcagaagcacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22791 - RNA, 1623 nt, Artificial Sequence
  derived and/or modified sequence opt4 from VP1__Norovirus__AGS08125
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccguguucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22792 - RNA, 1623 nt, Artificial Sequence; identical to SEQ ID NO: 22729
  derived and/or modified sequence opt4 from VP1__Norovirus__AGS08126

SEQ ID NO: 22793 - RNA, 1623 nt, Artificial Sequence; identical to SEQ ID NO: 22264
  derived and/or modified sequence opt4 from VP1__Norovirus__AGS08127

SEQ ID NO: 22794 - RNA, 1623 nt, Artificial Sequence
  derived and/or modified sequence opt4 from VP1__Norovirus__AGS08128
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgugaccaaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22795 - RNA, 1623 nt, Artificial Sequence
  derived and/or modified sequence opt4 from VP1__Norovirus__AGS08129
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagccacaacuacaccaugaaccuggccagccagaacuggaacagcuacgaccccaccgaggagauccccgccccccugggcacccccgacuucgugggcaagauccagggcaugcugacccagaccaccagaaccgacggcagcaccagaggccacaaggccaccguguacaccggcagcguggacuucagccccaagcugggcagagugcaguucaccaccgacaccgacaacgacuucgagaccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22796 - RNA, 1623 nt, Artificial Sequence
  derived and/or modified sequence opt4 from VP1__Norovirus__AGS08130
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagagccgacggcagcaccagaggccacaaggccaccguguacaccggcagcgccgacuucagccccaagcugggcagagugcaguucgccaccgacaccgacaacgacuucguggccaaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22797 - RNA, 1623 nt, Artificial Sequence
  derived and/or modified sequence opt4 from VP1__Norovirus__AGS08131
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcaacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaucggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagccguguga

SEQ ID NO: 22798 - RNA, 1623 nt, Artificial Sequence
  derived and/or modified sequence opt4 from VP1__Norovirus__AGS08132
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagccacaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcggcaccacccacagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22799 - RNA, 1623 nt, Artificial Sequence
  derived and/or modified sequence opt4 from VP1__Norovirus__AGS08133
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccagcuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgugaccaaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22800 - RNA, 1623 nt, Artificial Sequence
  derived and/or modified sequence opt4 from VP1__Norovirus__AGS08134
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacgugugcaccuucagaggcgacgugacccacauccccggcagccacaacuacaccaugaaccuggccagccagaacuggaacagcuacgaccccaccgaggagauccccgccccccugggcacccccgacuucgugggcaagauccagggcgugcugacccagaccaccagcaccaacggcagcaccagaggccacaaggccaccguguacaccggcagcgccgacuucagccccaagcugggcagagugcaguucgccaccgacaccaacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22801 - RNA, 1623 nt, Artificial Sequence
  derived and/or modified sequence opt4 from VP1__Norovirus__AGS08135
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcagguggugcuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgugaccaaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22802 - RNA, 1623 nt, Artificial Sequence; identical to SEQ ID NO: 22719
  derived and/or modified sequence opt4 from VP1__Norovirus__AGS08136

SEQ ID NO: 22803 - RNA, 1623 nt, Artificial Sequence
  derived and/or modified sequence opt4 from VP1__Norovirus__AGS08137
augaagauggccagcagcgacgccaaccccagcgacggcagcagcgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgugaccaaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaaagagagcccuguga

SEQ ID NO: 22804 - RNA, 1623 nt, Artificial Sequence; identical to SEQ ID NO: 22740
  derived and/or modified sequence opt4 from VP1__Norovirus__AGS08138

SEQ ID NO: 22805 - RNA, 1623 nt, Artificial Sequence
  derived and/or modified sequence opt4 from VP1__Norovirus__AGS08139
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagugguguga

SEQ ID NO: 22806 - RNA, 1623 nt, Artificial Sequence
  derived and/or modified sequence opt4 from VP1__Norovirus__AGS08140
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagugguguga

SEQ ID NO: 22807 - RNA, 1623 nt, Artificial Sequence
  derived and/or modified sequence opt4 from VP1__Norovirus__AGS08141
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcgcccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagugguguga

SEQ ID NO: 22808 - RNA, 1623 nt, Artificial Sequence
  derived and/or modified sequence opt4 from VP1__Norovirus__AGS08142
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagagccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccccuga

SEQ ID NO: 22809 - RNA, 1623 nt, Artificial Sequence; identical to SEQ ID NO: 22072
  derived and/or modified sequence opt4 from VP1__Norovirus__AGS08143

SEQ ID NO: 22810 - RNA, 1623 nt, Artificial Sequence
  derived and/or modified sequence opt4 from VP1__Norovirus__AGS08144
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagcccggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22811 - RNA, 1623 nt, Artificial Sequence
  derived and/or modified sequence opt4 from VP1__Norovirus__AGS08145
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagccacaacuacaccaugaaccuggccagccagaacuggaacagcuacgaccccaccgaggagacccccgccccccugggcacccccgacuucgugggcaagauccagggcgugcugacccagaccaccagcaccaacggcagcaccagaggccacaaggccaccguguacaccggcagcgccgacuucagccccaagcugggcagagugcaguucgccaccgacaccaacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22812 - RNA, 1623 nt, Artificial Sequence; identical to SEQ ID NO: 22771
  derived and/or modified sequence opt4 from VP1__Norovirus__AGS08146

SEQ ID NO: 22813 - RNA, 1623 nt, Artificial Sequence; identical to SEQ ID NO: 22112
  derived and/or modified sequence opt4 from VP1__Norovirus__AGS08147

SEQ ID NO: 22814 - RNA, 1623 nt, Artificial Sequence; identical to SEQ ID NO: 22719
  derived and/or modified sequence opt4 from VP1__Norovirus__AGS08148

SEQ ID NO: 22815 - RNA, 1623 nt, Artificial Sequence
  derived and/or modified sequence opt4 from VP1__Norovirus__AGS08149
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggaacgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcaagugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22816 - RNA, 1623 nt, Artificial Sequence; identical to SEQ ID NO: 22765
  derived and/or modified sequence opt4 from VP1__Norovirus__AGS08150

SEQ ID NO: 22817 - RNA, 1623 nt, Artificial Sequence
  derived and/or modified sequence opt4 from VP1__Norovirus__AGS08152
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccgugccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagccacaacuacaccaugaaccuggccagccagaacuggaacagcuacgaccccaccgaggagauccccgccccccugggcacccccgacuucgugggcaagauccagggcgugcugacccagaccaccagagccaacggcagcaccagaggccacaaggccaccguguacaccggcagcgccgacuucgcccccaagcugggcagagugcaguucgccaccgacaccaacaacgacuucgacgccaaccagaacaccaaguucacccccgugggcgugauccaggacggcgacaccgcccacagaaacgagccccagcagugggugcugcccagcuacagcggcagaaacagccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22818 - RNA, 1623 nt, Artificial Sequence
  derived and/or modified sequence opt4 from VP1__Norovirus__AGS08153
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccgugccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagccacaacuacaccaugaaccuggccagccagaacuggaacagcuacgaccccaccgaggagauccccgccccccugggcacccccgacuucgugggcaagauccagggcgugcugacccagaccaccagagccgacggcagcaccagaggccacaaggccaccguguacaccggcagcgccgacuucgcccccaagcugggcagagugcaguucgccaccgacaccaacaacgacuucgacgccaaccagaacaccaaguucacccccgugggcgugauccaggacggcgacaccgcccacagaaacgagccccagcagugggugcugcccagcuacagcggcagaaacagccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22819 - RNA, 1623 nt, Artificial Sequence
  derived and/or modified sequence opt4 from VP1__Norovirus__AGS08154
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgagguggaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcacccugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagugguguga

SEQ ID NO: 22820 - RNA, 1623 nt, Artificial Sequence; identical to SEQ ID NO: 22727
  derived and/or modified sequence opt4 from VP1__Norovirus__AGS08157

SEQ ID NO: 22821 - RNA, 1623 nt, Artificial Sequence
  derived and/or modified sequence opt4 from VP1__Norovirus__AGS08158
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagugaucuga

SEQ ID NO: 22822 - RNA, 1623 nt, Artificial Sequence; identical to SEQ ID NO: 22731
  derived and/or modified sequence opt4 from VP1__Norovirus__AGS08160

SEQ ID NO: 22823 - RNA, 1623 nt, Artificial Sequence
  derived and/or modified sequence opt4 from VP1__Norovirus__AGS08161
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagccguguga

SEQ ID NO: 22824 - RNA, 1623 nt, Artificial Sequence
  derived and/or modified sequence opt4 from VP1__Norovirus__AGS08162
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagugguguga

SEQ ID NO: 22825 - RNA, 1623 nt, Artificial Sequence; identical to SEQ ID NO: 22824
  derived and/or modified sequence opt4 from VP1__Norovirus__AGS08163

SEQ ID NO: 22826 - RNA, 1623 nt, Artificial Sequence; identical to SEQ ID NO: 22729
  derived and/or modified sequence opt4 from VP1__Norovirus__AGS08164

SEQ ID NO: 22827 - RNA, 1623 nt, Artificial Sequence
  derived and/or modified sequence opt4 from VP1__Norovirus__AGS08165
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgagguggaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagugguguga

SEQ ID NO: 22828 - RNA, 1623 nt, Artificial Sequence; identical to SEQ ID NO: 22824
  derived and/or modified sequence opt4 from VP1__Norovirus__AGS08166

SEQ ID NO: 22829 - RNA, 1623 nt, Artificial Sequence
  derived and/or modified sequence opt4 from VP1__Norovirus__AGS08167
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcaacgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagugguguga

SEQ ID NO: 22830 - RNA, 1623 nt, Artificial Sequence; identical to SEQ ID NO: 22827
  derived and/or modified sequence opt4 from VP1__Norovirus__AGS08168

SEQ ID NO: 22831 - RNA, 1623 nt, Artificial Sequence
  derived and/or modified sequence opt4 from VP1__Norovirus__AGS08169
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacaucagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagugguguga

SEQ ID NO: 22832 - RNA, 1623 nt, Artificial Sequence; identical to SEQ ID NO: 22824
  derived and/or modified sequence opt4 from VP1__Norovirus__AGS08170

SEQ ID NO: 22833 - RNA, 1623 nt, Artificial Sequence
  derived and/or modified sequence opt4 from VP1__Norovirus__AGS08171
augaagauggccagcagcgacgccaaccccagcgacggcagcgccgccaaccuggugcccgaggugaacaacgaggugauggcccuggaccccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagugguguga

SEQ ID NO: 22834 - RNA, 1623 nt, Artificial Sequence; identical to SEQ ID NO: 22729
  derived and/or modified sequence opt4 from VP1__Norovirus__AGS08172

SEQ ID NO: 22835 - RNA, 1623 nt, Artificial Sequence; identical to SEQ ID NO: 22827
  derived and/or modified sequence opt4 from VP1__Norovirus__AGS08173

SEQ ID NO: 22836 - RNA, 1623 nt, Artificial Sequence; identical to SEQ ID NO: 22824
  derived and/or modified sequence opt4 from VP1__Norovirus__AGS08174

SEQ ID NO: 22837 - RNA, 1623 nt, Artificial Sequence; identical to SEQ ID NO: 22723
  derived and/or modified sequence opt4 from VP1__Norovirus__AGS08175

SEQ ID NO: 22838 - RNA, 1623 nt, Artificial Sequence; identical to SEQ ID NO: 22824
  derived and/or modified sequence opt4 from VP1__Norovirus__AGS08176

SEQ ID NO: 22839 - RNA, 1623 nt, Artificial Sequence; identical to SEQ ID NO: 22827
  derived and/or modified sequence opt4 from VP1__Norovirus__AGS08177

SEQ ID NO: 22840 - RNA, 1623 nt, Artificial Sequence; identical to SEQ ID NO: 22824
  derived and/or modified sequence opt4 from VP1__Norovirus__AGS08178

SEQ ID NO: 22841 - RNA, 1623 nt, Artificial Sequence; identical to SEQ ID NO: 22824
  derived and/or modified sequence opt4 from VP1__Norovirus__AGS08179

SEQ ID NO: 22842 - RNA, 1623 nt, Artificial Sequence; identical to SEQ ID NO: 22824
  derived and/or modified sequence opt4 from VP1__Norovirus__AGS08180

SEQ ID NO: 22843 - RNA, 1623 nt, Artificial Sequence; identical to SEQ ID NO: 22827
  derived and/or modified sequence opt4 from VP1__Norovirus__AGS08181

SEQ ID NO: 22844 - RNA, 1623 nt, Artificial Sequence; identical to SEQ ID NO: 22827
  derived and/or modified sequence opt4 from VP1__Norovirus__AGS08182

SEQ ID NO: 22845 - RNA, 1647 nt, Artificial Sequence
  derived and/or modified sequence opt4 from VP1__Norovirus__AGT39181
augaagauggccagcaacgacgccacccccagcaacgacggcgccgccggccuggugcccgagaucaacaacgaggccauggcccuggaccccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgccuucaccgccggcaagaucaucuucgccgccaucccccccaacuuccccaucgacaaccugagcgccgcccagaucaccaugugcccccacgugaucguggacgugagacagcuggagcccgugaaccugcccaugcccgacgugagaaacaacuucuuccacuacaaccagggcagcgacagcagacugagacugguggccaugcuguacaccccccugagagccaacaacagcggcgacgacguguucaccgugagcugcagagugcugaccagacccagccccgacuucagcuucaacuuccuggugccccccaccguggagagcaagaccaagcccuucacccugcccauccugaccaucagcgagaugagcaacagcagauuccccgugcccaucgacagccugcacaccagccccaccgagaacaucguggugcagugccagaacggcagagugacccuggacggcgagcugaugggcaccacccagcugcugcccagccagaucugcgccuucagaggcgugcugaccagaagcaccagcagagccagcgaccaggccgacaccgccacccccagacuguucaacuacuacuggcacauccagcuggacaaccugaacggcacccccuacgaccccgccgaggacauccccggcccccugggcacccccgacuucagaggcaagguguucggcguggccagccagagaaaccccgacagcaccaccagagcccacgaggccaagguggacaccaccgccggcagauucacccccaagcugggcagccuggagaucagcaccgagagcggcgacuucgaccagaaccagcccaccagauucacccccgugggcaucggcguggacagagaggccgacuuccagcaguggagccugcccgacuacagcggccaguucacccacaacaugaaccuggcccccgccguggcccccaacuuccccggcgagcagcugcuguucuucagaagccagcugcccagcagcggcggcagaagcaacggcauccuggacugccuggugccccaggagugggugcagcacuucuaccaggagagcgcccccgcccagacccagguggcccuggugagauacgugaaccccgacaccggcagagugcuguucgaggccaagcugcacaagcugggcuucaugaccaucgccaagaacggcgacagccccaucaccgugccccccaacggcuacuucagauucgagagcugggugaaccccuucuacacccuggcccccaugggcaccggcaacggcagaagaagaauccaguga

SEQ ID NO: 22846 - RNA, 1608 nt, Artificial Sequence
  derived and/or modified sequence opt4 from VP1__Norovirus__AGT39191
augaagauggccagcaacgacgccgcccccagcaacgacggcgccgccggccuggugcccgaggugaccaacgagaccauggcccuggagcccguggccagagccagcaucgccgccccccugaccggccagaacaacgugaucgaccccuggaucacccugaacuucggccaggcccccaccggccaccugacccugagcccccccuacagccccggcgaggugcugcugaaccuggagcugagacccgagcugaaccccuaccuggccaaccugagcagaauguacaacggcuacgccggcggcguggaggugcaggugcugcuggccggcaacgccuucaccgccggcaagcugguguucgccgccgugcccccccacuucccccuggagaacaucagccccggccagaucaccauguucccccacgugaucaucgacgugagaacccuggagcccgugcugcugccccugcccgacgugagaaacaacuucuuccacuacaaccagcagaacgagcccagaaugagacugguggccaugcuguacaccccccugagaagcaacggcagcggcgacgacguguucaccgugagcugcagagugcugaccagacccagccccgacuucgacuucaacuaccuggugccccccaccguggagagcaagaccaagcccuucacccugcccauccugaccaucggcgagcugaccaacagcagauuccccgugcccaucgacgagcuguacaccagccccaacgagagccugguggugcagccccagaacggcagaugcgcccuggacggcgagcugcagggcaccacccagcugcugcccaccgccaucugcagcuucagaggcagaaucaaccagaaggugagcggcgagaaccacguguggaacaugcagaucaccaacaucaacggcacccccuucgaccccaccgaggacgugcccgccccccugggcacccccgacuucagcggcaagcuguucggcgugcugagccagagagaccacgacaacgccugcagaagccacgacgccgugaucgccaccaacagcgccaaguucacccccaagcugggcgccauccagaucggcaccugggagcaggacgacgugcacaucaaccagcccaccaaguucacccccgugggccuguucgagagcgagggcuucaaccaguggacccugcccaacuacagcggcgcccugacccugaacaugggccuggccccccccguggcccccaccuuccccggcgagcagauccuguucuucagaagccacaucccccugaagggcggcguggccgaccccgugaucgacugccugcugccccaggaguggauccagcaccuguaccaggagagcgcccccagccagaccgacguggcccugaucagauucaccaaccccgacaccggcagagugcuguucgaggccaagcugcacagaagcggcuacaucaccguggccaacaccggcagcagacccaucguggugcccgccaacggcuacuucagauucgacagcugggugaaccaguucuacagccuggcccccaugggcaccggcaacggcagaagaagagugcaguga

SEQ ID NO: 22847 - RNA, 1608 nt, Artificial Sequence
  derived and/or modified sequence opt4 from VP1__Norovirus__AGT39194
augaagauggccagcaacgacgccgcccccagcaacgacggcgccgccggccuggugcccgaggugaacaacgagaccauggcccuggagcccguggccggcgccagcaucgccgccccccugaccggccagaacaacgugaucgaccccuggaucagacugaacuucgugcaggcccccaacggcgaguucaccgugagccccagaaacagccccggcgaggugcugcugaaccuggagcugggccccgagcugaaccccuaccuggcccaccugagcagaauguacaacggcuacgccggcggcguggaggugcaggugcugcuggccggcaacgccuucaccgccggcaagcugguguucgccgccgugcccccccacuucccccuggagaacaucagccccggccagaucaccauguucccccacgugaucaucgacgugagaacccuggagcccgugcugcugccccugcccgacgugagaaacaacuucuuccacuacaaccagcagaacgagcccagaaugagacugguggccaugcuguacaccccccugagaagcaacggcagcggcgacgacguguucaccgugagcugcagagugcugaccagacccagccccgacuucgacuucaacuaccuggugccccccaccguggagagcaagaccaagcccuucacccugcccauccugaccaucggcgagcugaccaacagcagauuccccgugcccaucgacgagcuguacaccagccccaacgagagccugguggugcagccccagaacggcagaugcgcccuggacggcgagcugcagggcaccacccagcugcugcccaccgccaucugcagcuucagaggcagaaucaaccagaaggugagcggcgagaaccacguguggaacaugcagaucaccaacaucaacggcacccccuucgaccccaccgaggacgugcccgccccccugggcacccccgacuucagcggcaagcuguucggcgugcugagccagagagaccacgacaacgccugcagaagccacgacgccgugaucgccaccaacagcgccaaguucacccccaagcugggcgccauccagaucggcaccugggagcaggacgacgugcacaucaaccagcccaccaaguucacccccgugggccuguucgagagcgagggcuucaaccaguggacccugcccaacuacagcggcgcccugacccugaacaugggccuggccccccccguggcccccaccuuccccggcgagcagauccuguucuucagaagccacaucccccugaagggcggcguggccgaccccgugaucgacugccugcugccccaggaguggauccagcaccuguaccaggagagcgcccccagccagaccgacguggcccugaucagauucaccaaccccgacaccggcagagugcuguucgaggccaagcugcacagaagcggcuacaucaccguggccaacaccggcagcagacccaucguggugcccgccaacggcuacuucagauucgacagcugggugaaccaguucuacagccuggcccccaugggcaccggcaacggcagaagaagagugcaguga

SEQ ID NO: 22848 - RNA, 1608 nt, Artificial Sequence
  derived and/or modified sequence opt4 from VP1__Norovirus__AGT39197
augaagauggccagcaacgacgccgcccccagcaacgacggcgccgccggccuggugcccgaggugaacaacgagaccauggcccuggagcccguggccggcgccagcaucgccgccccccugaccggccagaacaacgugaucgaccccuggaucagacugaacuucgugcaggcccccaacggcgaguucaccgugagccccagaaacagccccggcgaggugcugcugaaccuggagcugggccccgagcugaaccccuaccuggcccaccugagcagaauguacaacggcuacgccggcggcguggaggugcaggugcugcuggccggcaacgccuucaccgccggcaagcugguguucgccgccgugcccccccacuucccccuggagaacaucagccccggccagaucaccauguucccccacgugaucaucgacgugagaacccuggagcccgugcugcugccccugcccgacgugagaaacaacuucuuccacuacaaccagcagaacgagcccagaaugagacugguggccaugcuguacaccccccugagaagcaacggcagcggcgacgacguguucaccgugagcugcagagugcugaccagacccagccccgacuucgacuucaacuaccuggugccccccaccguggagagcaagaccaagcccuucacccugcccauccugaccaucggcgagcugaccaacagcagauuccccgugcccaucgacgagcuguacaccagccccaacgagagccugguggugcagccccagaacggcagaugcgcccuggacggcgagcugcagggcaccacccagcugcugcccaccgccaucugcagcuucagaggcagaaucaaccagaaggugagcggcgagaaccacguguggaacaugcaggugaccaacaucaacggcacccccuucgaccccaccgaggacgugcccgccccccugggcacccccgacuucagcggcaagcuguucggcgugcugagccagagagaccacgacaacgccugcagaagccacgacgccgugaucgccaccaacagcgccaaguucacccccaagcugggcgccauccagaucggcaccugggaggagaacgacgugcacaucaaccagcccaccaaguucacccccgugggccuguucgagagcgagggcuucaaccaguggacccugcccaacuacagcggcgcccugacccugaacaugggccuggccccccccguggcccccaccuuccccggcgagcagauccuguucuucagaagccacaucccccugaagggcggcguggccgaccccgugaucgacugccugcugccccaggaguggauccagcaccuguaccaggagagcgcccccagccagaccgacguggcccugaucagauucaccaaccccgacaccggcagagugcuguucgaggccaagcugcacagaagcggcuacaucaccguggccaacaccggcagcagacccaucguggugcccgccaacggcuacuucagauucgacagcugggugaaccaguucuacagccuggcccccaugggcaccggcaacggcagaagaagagugcaguga

SEQ ID NO: 22849 - RNA, 1608 nt, Artificial Sequence
  derived and/or modified sequence opt4 from VP1__Norovirus__AGT39200
augaagauggccagcaacgacgccgcccccagcaacgacggcgccgccggccuggugcccgaggugaacaacgagaccauggcccuggagcccguggccggcgccagcaucgccgccccccugaccggccagaacaacgugaucgaccccuggaucagacugaacuucgugcaggcccccaacggcgaguucaccgugagccccagaaacagccccggcgaggugcugcugaaccuggagcugggccccgagcugaaccccuaccuggcccaccugagcagaauguacaacggcuacgccggcggcguggaggugcaggugcugcuggccggcaacgccuucaccgccggcaagcugguguucgccgccgugcccccccacuucccccuggagaacaucagccccggccagaucaccauguucccccacgugaucaucgacgugagaacccuggagcccgugcugcugccccugcccgacgugagaaacaacuucuuccacuacaaccagcagaacgagcccagaaugagacugguggccaugcuguacaccccccugagaagcaacggcagcggcgacgacguguucaccgugagcugcagagugcugaccagacccagccccgacuucgacuucaacuaccuggugccccccaccguggagagcaagaccaagcccuucacccugcccauccugaccaucggcgagcugaccaacagcagauuccccgugcccaucgacgagcuguacaccagccccaacgagagccugguggugcagccccagaacggcagaugcgcccuggacggcgagcugcagggcaccacccagcugcugcccaccgccaucugcagcuucagaggcagaaucaaccagaaggugagcggcgagaaccacguguggaacaugcagaucaccaacaucaacggcacccccuucggccccaccgaggacgugcccgccccccugggcacccccgacuucagcggcaagcuguucggcgugcugagccagagagaccacgacaacgccugcagaagccacgacgccgugaucgccaccaacagcgccaaguucacccccaagcugggcgccauccagaucggcaccugggagcaggacgacgugcacaucaaccagcccaccaaguucacccccgugggccuguucgagagcgagggcuucaaccaguggacccugcccaacuacagcggcgcccugacccugaacaugggccuggccccccccguggcccccaccuuccccggcgagcagauccuguucuacagaagccacaucccccugaagggcggcguggccgaccccgugaucgacugccugcugccccaggaguggauccagcaccuguaccaggagagcgcccccagccagaccgacguggcccugaucagauucaccaaccccgacaccggcagagugcuguucgaggccaagcugcacagaagcggcuacaucaccguggccaacaccggcagcagacccaucguggugcccgccaacggcuacuucagauucgacagcugggugaaccaguucuacagccuggcccccaugggcaccggcaacggcagaagaagagugcaguga

SEQ ID NO: 22850 - RNA, 1608 nt, Artificial Sequence; identical to SEQ ID NO: 22278
  derived and/or modified sequence opt4 from VP1__Norovirus__AGT39203

SEQ ID NO: 22851 - RNA, 1629 nt, Artificial Sequence
  derived and/or modified sequence opt4 from VP1__Norovirus__AGT39206
augaagauggccagcaacgacgccgcccccagcaccgacggcgccgccggccuggugcccgagagcaacaacgaggugauggcccuggagcccguggccggcgccgcccuggccgcccccgugaccggccagaccaacaucaucgaccccuggaucagagccaacuucgugcaggcccccaacggcgaguucaccgugagccccagaaacagccccggcgaggugcugcugaaccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccguggagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauuccccgugagcaucgaccagauguacaccagccccaacgaggugaucagcgugcagugccagaacggcagaugcacccuggacggcgagcugcagggcaccacccagcugcaggugagcggcaucugcgccuucaagggcgaggugaccgcccaccugcacgacaacgaccaccuguacaacgugaccaucaccaaccugaacggcagccccuucgaccccagcgaggacauccccgccccccugggcgugcccgacuuccagggcagaguguucggcgugaucagccagagagacaagcacaacacccccggccacaacgagcccgccaacagagcccacgacgccguggugcccaccuacaccgcccaguacacccccaagcugggccagauccagaucggcaccuggcagaccgacgaccugaccgugaaccagcccgugaaguucacccccgugggccugaacgacaccgaccacuucaaccaguggguggugcccagauacgccggcgcccugaaccugaacaccaaccuggcccccagcguggcccccguguuccccggcgagagacugcuguucuucagaagcuacaucccccugaagggcggcuacggcacccccgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagaauccaguga

SEQ ID NO: 22852 - RNA, 1623 nt, Artificial Sequence
  derived and/or modified sequence opt4 from VP1__Norovirus__AHF45991
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacagcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccagcacccaggaguacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcgugcacuucacccccaagcugggcagaauccaguucagcaccgacaccagcaacgacuucgagaccggccagaacaccagauucacccccgugggcguggugcaggacggcagcaccacccaccagaacgagccccagcagugggugcugcccaacuacagcggcagagacagccacaacgugcaccuggcccccgccguggcccccagcuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22853 - RNA, 1623 nt, Artificial Sequence; identical to SEQ ID NO: 22072
  derived and/or modified sequence opt4 from VP1__Norovirus__AHF45993

SEQ ID NO: 22854 - RNA, 1623 nt, Artificial Sequence; identical to SEQ ID NO: 22729
  derived and/or modified sequence opt4 from VP1__Norovirus__AHF45997

SEQ ID NO: 22855 - RNA, 1623 nt, Artificial Sequence; identical to SEQ ID NO: 22729
  derived and/or modified sequence opt4 from VP1__Norovirus__AHF45999

SEQ ID NO: 22856 - RNA, 1623 nt, Artificial Sequence; identical to SEQ ID NO: 22729
  derived and/or modified sequence opt4 from VP1__Norovirus__AHF46001

SEQ ID NO: 22857 - RNA, 1617 nt, Artificial Sequence
  derived and/or modified sequence opt4 from VP1__Norovirus__AHH44876
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccaucagccccagaaacgcccccggcgagauccuguggagcgccccccugggccccgaccugaaccccuaccugagccaccuggccagaauguacaacggcuacgccggcggcuucgaggugcagguggugcuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagcgccgugaacaucugcaccuucagaggcgacgugacccacgugagcgacaagaccuucgccaugaaccuggccagccccaacuggaacaacuacgaccccaccgaggacauccccgccccccugggcacccccgacuucgugggcagaauccacggcaugcugacccagaccaccagaagagacggcgccaccagaggccacaaggccaccgugagcaccggcggcgccgacuucacccccaagcugggcagcgugagauacaucaccgacaccaccgacgaccuggaggugagagagaacaccaaguucacccccaucggcgugcugcacagcagcggcgagcacagagccgagcccgaccaguggagacugcccgaguacagcggcagaaacgugcacaacgugcaccuggcccccgccguggcccccaccuuccccggcgagcagcugcuguucuucagaagcgcccugcccggcugcggcggcuaccccaacaccgaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcaccggcagaagaagagcccuguga

SEQ ID NO: 22858 - RNA, 1617 nt, Artificial Sequence
  derived and/or modified sequence opt4 from VP1__Norovirus__AHH44877
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccaucagccccagaaacgcccccggcgagauccuguggagcgccccccugggccccgaccugaaccccuaccugagccaccuggccagaauguacaacggcuacgccggcggcuucgaggugcagguggugcuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaaggacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagcgccgugaacaucugcaccuucagaggcgacgugacccacguggccggcgacaccuucgccaugaaccuggccagccugaacuggaacaacuacgaccccaccgaggagacccccgccccccugggcacccccgacuucgugggcagaauccacggcaugcugacccagaccaccagaagcgacggcgccaccagagcccacaaggccaccgugagcaccggcggcgccgacuucacccccaagcugggcagcgugagauacagcaccgacaccagcggcgaccuggaggugagagagaacaccaaguucacccccaucggcgugcugcacagcagcggcgagagaagagccgagcccgagcaguggagacugcccgaguacagcggcagaaacgugcacaacgugcaccuggcccccgccguggcccccaccuuccccggcgagcagcugcuguucuucagaagcaccaugcccggcugcggcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcaccggcagaagaagagcccuguga

SEQ ID NO: 22859 - RNA, 1617 nt, Artificial Sequence
  derived and/or modified sequence opt4 from VP1__Norovirus__AHH44878
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccaucagccccagaaacgcccccggcgagauccuguggagcgccccccugggccccgaccugaaccccuaccugagccaccuggccagaauguacaacggcuacgccggcggcuucgaggugcagguggugcuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaaggacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagcgccgugaacaucugcaccuucagaggcgacgugacccacguggccggcgacaccuucgccaugaaccuggccagccugaacuggaacaacuacgaccccaccgaggagacccccgccccccugggcacccccgacuucgugggcagaauccacggcaugcugacccagaccaccagaagcgacggcgccaccagagcccacaaggccaccgugagcaccggcggcgccgacuucacccccaagcugggcagcgugagauacagcaccgacaccagcagcgaccuggaggugagagagaacaccaaguucacccccaucggcgugcugcacagcagcggcggccacagagccgagcccgaccaguggagacugcccgaguacagcggcagaaacgugcacaacgugcaccuggcccccgccguggcccccaccuuccccggcgagcagcugcuguucuucagaagcaccaugcccggcugcggcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcaccggcagaagaagagcccuguga

SEQ ID NO: 22860 - RNA, 1617 nt, Artificial Sequence
  derived and/or modified sequence opt4 from VP1__Norovirus__AHH44879
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccaucagccccagaaacgcccccggcgagauccuguggagcgccccccugggccccgaccugaaccccuaccugagccaccuggccagaauguacaacggcuacgccggcggcuucgaggugcagguggugcuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaaggacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagcgccgugaacaucugcaccuucagaggcgacgugacccacguggccggcgacaccuucgccaugaaccuggccagccugaacuggaacaacuacgaccccaccgaggagacccccgccccccugggcacccccgacuucgugggcagaauccacggcaugcugacccagaccaccagaagcgacggcgccaccagagcccacaaggccaccgugagcaccggcggcgccgacuucacccccaagcugggcagcgugagauacagcaccgacaccagcagcgaccuggaggugagagagaacaccaaguucacccccaucggcgugcugcacagcagcggcggccacagagccgagcccgaccaguggagacugcccgaguacagcggcagaaacgugcacaacgugcaccuggcccccgccguggcccccaccuuccccggcgagcagcugcuguucuucagaagcaccaugcccggcugcggcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcaccggcagaagaagagcccuguga

SEQ ID NO: 22861 - RNA, 1617 nt, Artificial Sequence
  derived and/or modified sequence opt4 from VP1__Norovirus__AHH44880
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccaucagccccagaaacgcccccggcgagauccuguggagcgccccccugggccccgaccugaaccccuaccugagccaccuggccagaauguacaacggcuacgccggcggcuucgaggugcagguggugcuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaaggacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagcgccgugaacaucugcaccuucagaggcgacgugacccacguggccggcgacaccuucgccaugaaccuggccagccugaacuggaacaacuacgaccccaccgaggagacccccgccccccugggcacccccgacuucgugggcagaauccacggcaugcugacccagaccaccagaagcgacggcgccaccagagcccacaaggccaccgugagcaccggcggcgccgacuucacccccaagcugggcagcgugagauacagcaccgacaccagcagcgaccuggaggugagagagaacaccaaguucacccccaucggcgugcugcacagcagcggcggccacagagccgagcccgaccaguggagacugcccgaguacagcggcagaaacgugcacaacgugcaccuggcccccgccguggcccccaccuuccccggcgagcagcugcuguucuucagaagcaccaugcccggcugcggcggcuaccccaacauggaccuggacugccugcugccccaggagugggugcagcacuucuaccaggagaccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcaccggcagaagaagagcccuguga

SEQ ID NO: 22862 - RNA, 1617 nt, Artificial Sequence
  derived and/or modified sequence opt4 from VP1__Norovirus__AHH44881
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccaucagccccagaaacgcccccggcgagauccuguggagcgccccccugggccccgaccugaaccccuaccugagccaccuggccagaauguacaacggcuacgccggcggcuucgaggugcagguggugcuggccggcaacgccuucaccgccggcaaggugaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagcgccgugaacaucugcaccuucagaggcgacgugacccacguggccggcgacaccuucgccaugaaccuggccagccugaacuggaacaacuacgaccccaccgaggagacccccgccccccugggcacccccgacuucgugggcagaauccacggcaugcugacccagaccaccagaagcgacggcgccaccagagcccacaaggccaccgugagcaccggcggcgccgacuucacccccaagcugggcagcgugagauacagcaccgacaccagcagcgaccuggaggugagagagaacaccaaguucacccccaucggcgugcugcacagcagcggcggccacagagccgagcccgaccaguggagacugcccgaguacagcggcagaaacgugcacaacgugcaccuggcccccgccguggcccccaccuuccccggcgagcagcugcuguucuucagaagcaccaugcccggcugcggcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcaccggcagaagaagagcccuguga

SEQ ID NO: 22863 - RNA, 1617 nt, Artificial Sequence
  derived and/or modified sequence opt4 from VP1__Norovirus__AHH44884
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccaucagccccagaaacgcccccggcgagauccuguggagcgccccccugggccccgaccugaaccccuaccugagccaccuggccagaauguacaacggcuacgccggcggcuucgaggugcagguggugcuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaucaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccgugcugaccguggacgagaugaccaacagcagauuccccaucccccuggagaagcuguucaccggccccagcagcgccuucguggugcagccccagaacggcagaugcaccaccgacggcgugcugcugggcaccacccagcugagcgccgugaacaucugcaccuucagaggcgacgugacccacgugagcgacaagaccuucgccaugaaccuggccagccccaacuggaacaacuacgaccccaccgaggagauccccgccccccugggcacccccgacuucgugggcagaauccacggcaugcugacccagaccaccagaagagacggcgccaccagaggccacaaggccaccgugagcaccggcggcgccgacuucacccccaagcugggcagcgugagauacaucaccgacaccaccgacgaccuggaggugagagagaacaccaaguucacccccaucggcgugcugcacagcagcggcgagcacagagccgagcccgaccaguggagacugcccgaguacagcggcagaaacgugcacaacgugcaccuggcccccgccguggcccccaccuuccccggcgagcagcugcuguucuucagaagcgcccugcccggcugcggcggcuaccccaacaccgaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcaccggcagaagaagagcccuguga

SEQ ID NO: 22864 - RNA, 1620 nt, Artificial Sequence
  derived and/or modified sequence opt4 from VP1__Norovirus__AHH44886
augaagauggccagcaacgacgccagccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaaggaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaagcaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgaccugacccacuucaccggcaccagcgaguacgccaugaaccuggccagccagaacuggaacaacuacgaccccaccgaggagauccccgccccccugggcgcccccgacuucgugggcaagaucagaggcaugcugacccagaccaccagaagagacggcagcaccagaggccacagagccacccugagcaccggcagcgcccacuucacccccaagcugggcagcaucagauucagcaccgacaccaacaacgacuucgaggccggccagaacaccaaguucacccccgugggcguguuccaggagggcgacaaccaccagaacgagccccagcagugggugcugcccaacuacagcggcgccaccgcccacaacgugcaccuggcccccgccguggcccccgccuuccccggcgagcagcugcuguucuucagaagcaccaugcccggcugcggcggcuaccccaacaugaaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22865 - RNA, 1620 nt, Artificial Sequence
  derived and/or modified sequence opt4 from VP1__Norovirus__AHH44888
augaagauggccagcaacgacgccagccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaaggaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaagcaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgaccugacccacuucaccggcaccagcgaguacgccaugaaccuggccagccagaacuggaacaacuacgaccccaccgaggagauccccgccccccugggcgcccccgacuucgugggcaagaucagaggcaugcugacccagaccaccagaagagacggcagcaccagaggccacagagccacccugagcaccggcagcgcccacuucacccccaagcugggcaacaucagauucagcaccgacaccaacaacgacuucgaggccggccagaacaccaaguucacccccgugggcguguuccaggagggcgacaaccaccagaacgagccccagcagugggugcugcccaacuacagcggcgccaccgcccacaacgugcaccuggcccccgccguggcccccgccuuccccggcgagcagcugcuguucuucagaagcaccaugcccggcugcggcggcuaccccaacaugaaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22866 - RNA, 1620 nt, Artificial Sequence
  derived and/or modified sequence opt4 from VP1__Norovirus__AHH44889
augaagauggccagcaacgacgccagccccagcgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaaggaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaagcaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgaccugacccacuucaccggcaccagcgaguacgccaugaaccuggccagccagaacuggaacaacuacgaccccaccgaggagauccccgccccccugggcgcccccgacuucgugggcaagaucagaggcaugcugacccagaccaccagaagagacggcagcaccagaggccacagagccacccugagcaccggcagcgcccacuucacccccaagcugggcagcaucagauucagcaccgacaccaacaacgacuucgaggccggccagaacaccaaguucacccccgugggcaucuuccaggagggcgacaaccaccagaacgagccccagcagugggugcugcccaacuacagcggcgccaccgcccacaacgugcaccuggcccccgccguggcccccgccuuccccggcgagcagcugcuguucuucagaagcaccaugcccggcugcggcggcuaccccaacaugaaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22867 - RNA, 1620 nt, Artificial Sequence; identical to SEQ ID NO: 22865
  derived and/or modified sequence opt4 from VP1__Norovirus__AHH44890

SEQ ID NO: 22868 - RNA, 1620 nt, Artificial Sequence; identical to SEQ ID NO: 22865
  derived and/or modified sequence opt4 from VP1__Norovirus__AHH44891

SEQ ID NO: 22869 - RNA, 1620 nt, Artificial Sequence; identical to SEQ ID NO: 22865
  derived and/or modified sequence opt4 from VP1__Norovirus__AHH44893

SEQ ID NO: 22870 - RNA, 1620 nt, Artificial Sequence
  derived and/or modified sequence opt4 from VP1__Norovirus__AHH44894
augaagauggccagcaacgacgccagccccagcgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaaggaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaagcaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgaccugacccacuucaccggcaccagcgaguacgccaugaaccuggccagccagaacuggaacaacuacgaccccaccgaggagauccccgccccccugggcgcccccgacuucgugggcaagaucagaggcaugcugacccagaccaccagaagagacggcagcaccagaggccacagagccacccugagcaccggcagcgcccacuucacccccaagcugggcagcaucagauucagcaccgacaccaacaacgacuucgaggccagccagaacaccaaguucacccccgugggcguguuccaggagggcgacaaccaccagaacgagccccagcagugggugcugcccaacuacagcggcgccaccgcccacaacgugcaccuggcccccgccguggcccccgccuuccccggcgagcagcugcuguucuucagaagcaccaugcccggcugcggcggcuaccccaacaugaaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22871 - RNA, 1620 nt, Artificial Sequence
  derived and/or modified sequence opt4 from VP1__Norovirus__AHH44895
augaagauggccagcaacgacgccagccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaaggaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaagcaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgaccugacccacuucaccggcaccagcgaguacgccaugaaccuggccagccagaacugggacaacuacgaccccaccgaggagauccccgccccccugggcgcccccgacuucgugggcaagaucagaggcaugcugacccagaccaccagaagagacggcagcaccagaggccacagagccacccugagcaccggcagcgcccacuucacccccaagcugggcaacaucagauucagcaccgacaccaacaacgacuucgaggccggccagaacaccaaguucacccccgugggcguguuccaggagggcgacaaccaccagaacgagccccagcagugggugcugcccaacuacagcggcgccaccgcccacaacgugcaccuggcccccgccguggcccccgccuuccccggcgagcagcugcuguucuucagaagcaccaugcccggcugcggcggcuaccccaacaugaaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22872 - RNA, 1620 nt, Artificial Sequence; identical to SEQ ID NO: 22865
  derived and/or modified sequence opt4 from VP1__Norovirus__AHH44896

SEQ ID NO: 22873 - RNA, 1620 nt, Artificial Sequence; identical to SEQ ID NO: 22865
  derived and/or modified sequence opt4 from VP1__Norovirus__AHH44897

SEQ ID NO: 22874 - RNA, 1620 nt, Artificial Sequence; identical to SEQ ID NO: 22865
  derived and/or modified sequence opt4 from VP1__Norovirus__AHH44899

SEQ ID NO: 22875 - RNA, 1620 nt, Artificial Sequence
  derived and/or modified sequence opt4 from VP1__Norovirus__AHH44900
augaagauggccagcaacgacgccagccccagcgacggcagcgccgccaaccuggugcccgaggugaacaacgaggugauggcccuggagcccguggugggcgccaccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaaggaccccaccaucaagcugaucgccaugcuguacaccccccugagagccaacaacgccggcgaggacguguucaccgugagcugcagagugcugaccagacccagccccgacuucgacuucaucuuccuggugagccccaccguggagagcagaagcaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgaccugacccacuucaccggcaccagcgaguacgccaugaaccuggccagccagaacuggaacaacuacgaccccaccgaggagauccccgccccccugggcgcccccgacuucgugggcaagaucagaggcaugcugacccagaccaccagaagagacggcagcaccagaggccacagagccacccugagcaccggcagcgcccacuucacccccaagcugggcaacaucagauucagcaccgacaccaacaacgacuucgaggccggccagaacaccaaguucacccccgugggcguguuccaggagggcgacaaccaccagaacgagccccagcagugggugcugcccaacuacagcggcgccaccgcccacaacgugcaccuggcccccgccguggcccccgccuuccccggcgagcagcugcuguucuucagaagcaccaugcccggcugcggcggcuaccccaacaugaaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22876 - RNA, 1620 nt, Artificial Sequence; identical to SEQ ID NO: 22865
  derived and/or modified sequence opt4 from VP1__Norovirus__AHH44902

SEQ ID NO: 22877 - RNA, 1620 nt, Artificial Sequence
  derived and/or modified sequence opt4 from VP1__Norovirus__AHH44904
augaagauggccagcaacgacgccagccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaaggaccccaccaucaagcugaucgccaugcuguacaccccccugagagccaacaacgccggcgaggacguguucaccgugagcugcagagugcugaccagacccagccccgacuucgacuucaucuuccuggugagccccaccguggagagcagaagcaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgaccugacccacuucaccggcaccagcgaguacgccaugaaccuggccagccagaacuggaacaacuacgaccccaccgaggagauccccgccccccugggcgcccccgacuucgugggcaagaucagaggcaugcugacccagaccaccagaagagacggcagcaccagaggccacagagccacccugagcaccggcagcgcccacuucacccccaagcugggcaacaucagauucagcaccgacaccaacaacgacuucgaggccggccagaacaccaaguucacccccgugggcguguuccaggagggcgacaaccaccagaacgagccccagcagugggugcugcccaacuacagcggcgccaccgcccacaacgugcaccuggcccccgccguggcccccgccuuccccggcgagcagcugcuguucuucagaagcaccaugcccggcugcggcggcuaccccaacaugaaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22878 - RNA, 1620 nt, Artificial Sequence; identical to SEQ ID NO: 22865
  derived and/or modified sequence opt4 from VP1__Norovirus__AHH44905

SEQ ID NO: 22879 - RNA, 1620 nt, Artificial Sequence
  derived and/or modified sequence opt4 from VP1__Norovirus__AHH44906
augaagauggccagcaacgacgccagccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaaggaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaagcaagcccuucaccgugcccauccugaccguggaggagaugaccuacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgaccugacccacuucgccggcaccagcgaguacgccaugaaccuggccagccagaacuggaccaacuacgaccccaccgaggagauccccgccccccugggcgcccccgacuucgugggcaagaucagaggcgugcugacccagaccaccagaggcgacggcagcaccagaggccacagagccacccugagcaccggcagcgcccacuucacccccaagcugggcagcgugagauucagcaccgacaccaacaacgacuucgaggccggccagaacaccaaguucacccccgugggcguguuccaggacggcgacaaccaccagaacgagccccagcagugggugcugcccaacuacagcggcgccaccgcccacaacgugcaccuggcccccgccguggcccccgccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22880 - RNA, 1620 nt, Artificial Sequence
  derived and/or modified sequence opt4 from VP1__Norovirus__AHH44907
augaagauggccagcaacgacgccagccccagcgacggcagcgccgccaaccuggugcccgaggugaacaacgaggugauggcccuggagcccguggugggcgccgccaucgccgcccccguggccggccagcagaacgugaucgaccccuggaucagaaacaaguucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaaggaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaagcaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgaccugacccacuucgccggcacccacgaguacgccaugaaccuggccagccagaacuggaacaacuacgaccccaccgaggagauccccgccccccugggcgcccccgacuucgugggcaagaucagaggcgugcugacccagaccaccagaagagacggcagcaccagaggccacagagccacccugagcaccggcagcgcccacuucacccccaagcugggcagcaucagauucagcaccgacaccaacaacgacuucgaggccggccagaacaccaaguucacccccgugggcguguuccaggacggcgacaaccaccagaacgagccccagcagugggugcugcccaacuacagcggcgccaccgcccacaacgugcaccuggcccccgccguggcccccgccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaugcgcccuguga

SEQ ID NO: 22881 - RNA, 1620 nt, Artificial Sequence
  derived and/or modified sequence opt4 from VP1__Norovirus__AHH44908
augaagauggccagcaacgacgccagccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaaggaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaagcaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgaccugacccacuucgccggcaccagcgaguacgccaugaaccuggccagccagaacuggaccaacuacgaccccaccgaggagauccccgccccccugggcgcccccgacuucgugggcaagaucagaggcgugcugacccagaccaccagaggcgacggcagcaccagaggccacagagccacccugagcaccggcagcgcccacuucacccccaagcugggcagcgugagauucagcaccgacaccaacaacgacuucgaggccggccagaacaccaaguucacccccgugggcguguuccaggacggcgacaaccaccagaacgagccccagcagugggugcugcccaacuacagcggcgccaccgcccacaacgugcaccuggcccccgccguggcccccgccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22882 - RNA, 1620 nt, Artificial Sequence
  derived and/or modified sequence opt4 from VP1__Norovirus__AHH44909
augaagauggccagcaacgacgccagccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaaggaccccaccaucaagcugaucgccaugcuguacaccccccugagagccaacaacgccugggaggacguguucaccgugagcugcagagugcugaccagacccagccccgacuucgacuucaucuuccuggugccccccaccguggagagcagaagcaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgaccugacccacuucgccggcacccacgaguacgccaugaaccuggccagccagaacuggaacaacuacgaccccaccgaggagauccccgccccccugggcgcccccgacuucgugggcaagaucagaggcgugcugacccagaccaccagaagagacggcagcaccagaggccacagagccacccugagcaccggcagcgcccacuucacccccaagcugggcagcaucagauucagcaccgacaccaacaacgacuucgaggccggccagaacaccaaguucacccccgugggcguguuccaggacggcgacaaccaccagaacgagccccagcagugggugcugcccaacuacagcggcgccaccgcccacaacgugcaccuggcccccgccguggcccccgccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22883 - RNA, 1620 nt, Artificial Sequence
  derived and/or modified sequence opt4 from VP1__Norovirus__AHH44911
augaagauggccagcaacgacgccagccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaaggaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaagcaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgaccugacccacuucgccggcacccacgaguacgccaugaaccuggccagccagaacuggaacaacuacgaccccaccgaggagauccccgccccccugggcgcccccgacuucgugggcaagaucagaggcgugcugacccagaccaccagaagagacggcagcaccagaggccacagagccacccugagcaccggcagcgcccacuucacccccaagcugggcagcaucagauucagcaccgacaccaacaacgacuucgaggccggccagaacaccaaguucacccccgugggcguguuccaggacggcgacaaccaccagaacgagccccagcagugggugcugcccaacuacagcggcgccaccgcccacaacgugcaccuggcccccgccguggcccccgccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22884 - RNA, 1620 nt, Artificial Sequence
  derived and/or modified sequence opt4 from VP1__Norovirus__AHH44912
augaagauggccagcaacgacgccagccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaaggaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaagcaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgaccugacccacuucgccggcacccacgaguacgccaugaaccuggccagccagaacuggagcaacuacgaccccaccgaggagauccccgccccccugggcgcccccgacuucgugggcaagaucagaggcgugcugacccagaccaccagaggcgacggcagcaccagaggccacagagccacccugagcaccggcagcgcccacuucacccccaagcugggcagcaucagauucagcaccgacaccaacaacgacuucgaggccggccagaacaccaaguucacccccgugggcguguuccaggacggcgacaaccaccagaacgagccccagcagugggugcugcccaacuacagcggcgccaccgcccacaacgugcaccuggcccccgccguggcccccgccuuccccggcgagcagcugcuguucuucagaagcaccaugcccggcugcagcggcuaccccgacaugaaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22885 - RNA, 1620 nt, Artificial Sequence
  derived and/or modified sequence opt4 from VP1__Norovirus__AHH44913
augaagauggccagcaacgacgccagccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaaggaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaagcaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgaccugacccacuucgccggcaccagcgaguacgccaugaaccuggccagccagaacuggaccaacuacgaccccaccgaggagauccccgccccccugggcgcccccgacuucgugggcaagaucagaggcgugcugacccagaccaccagaagagacggcagcaccagaggccacagagccacccugagcaccggcagcgcccacuucacccccaagcugggcagcaucagauucagcaccgacaccaacaacgacuucgaggccggccagaacaccaaguucacccccgugggcguguuccaggacggcgacaaccaccagaacgagccccagcagugggugcugcccaacuacagcggcgccaccgcccacaacgugcaccuggcccccgccguggcccccgccuuccccggcgagcagcugcuguucuucagaagcaccaugcccggcugcagcggcuaccccaacaugaaccuggacugccugcugacccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22886 - RNA, 1620 nt, Artificial Sequence
  derived and/or modified sequence opt4 from VP1__Norovirus__AHH44914
augaagauggccagcaacgacgccagccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaaggaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaagcaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgaccugacccacuucgccggcacccacgaguacgccaugaaccuggccagccagaacuggaccaacuacgaccccaccgaggagauccccgccccccugggcgcccccgacuucgugggcaagaucagaggcgugcugacccagaccaccagaggcgacggcagcaccagaggccacagagccacccugagcaccggcagcgcccacuucacccccaagcugggcagcgugagauucagcaccgacaccaacaacgacuucgaggccggccagaacaccaaguucacccccgugggcguguuccaggacggcgacaaccaccagaacgagccccagcagugggugcugcccaacuacagcggcgccaccgcccacaacgugcaccuggcccccgccguggcccccgccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22887 - RNA, 1620 nt, Artificial Sequence
  derived and/or modified sequence opt4 from VP1__Norovirus__AHH44915
augaagauggccagcaacgacgccagccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaaggaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaagcaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgaccugacccacuucgccggcaccagcgaguacgccaugaaccuggccagccagaacuggaccaacuacgaccccaccgaggagauccccgccccccugggcgcccccgacuucgugggcaagaucagaggcgugcugacccagaccaccagaagagacggcagcaccagaggccacagagccacccugagcaccggcagcgcccacuucacccccaagcugggcagcaucagauucagcaccgacaccaacaacgacuucgaggccggccagaacaccaaguucacccccgugggcguguuccaggacggcgacaaccaccagaacgagccccagcagugggugcugcccaacuacagcggcgccaccgcccacaacgugcaccuggcccccgccguggcccccgccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22888 - RNA, 1623 nt, Artificial Sequence; identical to SEQ ID NO: 22675
  derived and/or modified sequence opt4 from VP1__Norovirus__AID60853

SEQ ID NO: 22889 - RNA, 1623 nt, Artificial Sequence; identical to SEQ ID NO: 22723
  derived and/or modified sequence opt4 from VP1__Norovirus__AID60855

SEQ ID NO: 22890 - RNA, 1623 nt, Artificial Sequence; identical to SEQ ID NO: 22723
  derived and/or modified sequence opt4 from VP1__Norovirus__AID60857

SEQ ID NO: 22891 - RNA, 1623 nt, Artificial Sequence; identical to SEQ ID NO: 22723
  derived and/or modified sequence opt4 from VP1__Norovirus__AID60859

SEQ ID NO: 22892 - RNA, 1623 nt, Artificial Sequence
  derived and/or modified sequence opt4 from VP1__Norovirus__AID60861
augaagauggccagcagcgacgccaaccccagcgacggcagcgccgccagccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaucggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22893 - RNA, 1623 nt, Artificial Sequence
  derived and/or modified sequence opt4 from VP1__Norovirus__AID60863
augaagauggccagcagcgacgccaaccccagcgacggcagcgccgccagccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22894 - RNA, 1623 nt, Artificial Sequence
  derived and/or modified sequence opt4 from VP1__Norovirus__AID60865
augaagauggccagcagcgacgccaaccccagcgacggcagcgccgccagccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacguggugaucgacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgagaccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22895 - RNA, 1623 nt, Artificial Sequence
  derived and/or modified sequence opt4 from VP1__Norovirus__AID60869
augaagauggccagcagcgacgccaaccccagcgacggcagcgccgccagccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagccacaacuacaccaugaaccuggccagccagaacuggagcaacuacgaccccaccgaggagauccccgccccccugggcacccccgacuucgugggcaagauccagggcgugcugacccagaccaccagaaccaacggcagcaccagaggccacaaggccaccguguacgccggcagcgccaacuucgcccccaagcugggcagagugcaguucgagaccgacaccgaccacgaccuggaggccaaccagaacaccaaguucacccccgugggcgugauccaggacggcaacaccacccacagaaacgagccccagcagugggugcugcccagcuacagcggcagaagcacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22896 - RNA, 1623 nt, Artificial Sequence
  derived and/or modified sequence opt4 from VP1__Norovirus__AID60871
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaccccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22897 - RNA, 1623 nt, Artificial Sequence
  derived and/or modified sequence opt4 from VP1__Norovirus__AID60875
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaccccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgagaccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgagagcugggugaaccaguucuacacccuggcccccaugggcaacggcaccggcagaagaagagcccuguga

SEQ ID NO: 22898 - RNA, 1623 nt, Artificial Sequence
  derived and/or modified sequence opt4 from VP1__Norovirus__AID60877
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaccccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgagaccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22899 - RNA, 1623 nt, Artificial Sequence; identical to SEQ ID NO: 22898
  derived and/or modified sequence opt4 from VP1__Norovirus__AID60879

SEQ ID NO: 22900 - RNA, 1623 nt, Artificial Sequence
  derived and/or modified sequence opt4 from VP1__Norovirus__AID60881
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaccccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgagaccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccauccccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22901 - RNA, 1623 nt, Artificial Sequence
  derived and/or modified sequence opt4 from VP1__Norovirus__AID60883
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccaucagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgaccugaucuuccuggugccccccaccguggagagcagaaccaagcccuucagcgugcccgugcugaccguggaggagaugaccaacagcagauuccccaccccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgagaccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccauccccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22902 - RNA, 1623 nt, Artificial Sequence; identical to SEQ ID NO: 22898
  derived and/or modified sequence opt4 from VP1__Norovirus__AID60885

SEQ ID NO: 22903 - RNA, 1623 nt, Artificial Sequence
  derived and/or modified sequence opt4 from VP1__Norovirus__AID60887
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaccccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgagaccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22904 - RNA, 1623 nt, Artificial Sequence
  derived and/or modified sequence opt4 from VP1__Norovirus__AID60889
augaagauggccagcagcgacgccaaccccugcgacggcagcgccgccaaccuggugcccgaggugaacaacgaggugauggcccuggagcccguggugggcgccgccaucgccgcccccgugggcggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaccccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaucggcagcgccgacuucgcccccaagcugggcagagugcaguucgagaccgacaccgaccacgacuucgagaccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcacccugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22905 - RNA, 1623 nt, Artificial Sequence
  derived and/or modified sequence opt4 from VP1__Norovirus__AID60893
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaccccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaucggcagcgccgacuucgcccccaagcugggcagagugcaguucgagaccgacaccgaccacgacuucgagaccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcacccugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22906 - RNA, 1623 nt, Artificial Sequence
  derived and/or modified sequence opt4 from VP1__Norovirus__AID68577
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgacagagacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22907 - RNA, 1623 nt, Artificial Sequence
  derived and/or modified sequence opt4 from VP1__Norovirus__AID68578
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagccacaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagaauccaguucgagaccgacaccaaccacgacuucgaggccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22908 - RNA, 1623 nt, Artificial Sequence
  derived and/or modified sequence opt4 from VP1__Norovirus__AID68579
augaagauggccagcagcgacgccaaccccagcgacggcagcgccgccaaccuggugcccgaggugaacaacgaggugcuggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagccacaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagaauccaguucgagaccgacaccaaccacgacuucgaggccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22909 - RNA, 1623 nt, Artificial Sequence; identical to SEQ ID NO: 22731
  derived and/or modified sequence opt4 from VP1__Norovirus__AID68581

SEQ ID NO: 22910 - RNA, 1623 nt, Artificial Sequence
  derived and/or modified sequence opt4 from VP1__Norovirus__AID69174
augagaauggccagcgacgacgccaagagcgcccccagcgaccuggagggcgccggccuggugcccgccaccgccgccccccugcccguggcccccguggccggcgcccaggccgccgagcccuucgccggccagaucaacgugaucgaccccuggaucuacaccaacuucgugcaggcccccaccggcgaguucaccgugagccccagaaacacccccggcgaggugcuggugaaccuggagaucggccccaaccugaaccccuaccugcagcaccuggcccagauguacaacggcuacgccggcggcguggaggugcaggugauccuggccggcaacgccuucaccgccggcaagcugcugugcgcccuggugccccccggcuuccccaccagcagcaucacccccgcccagcugaccaugcugccccacaccaucaucgacgugagaaccaccgaccccgugguggugcccaugcccgacgugagaagaacccuguggcacgaggugagaagcaccaccgagccccugaugagacuggugaucaugcuguacacccccaugagagccaacagcggcagcgacgaggccuucguggugagcggcagagugcugagcagacccgcccccgacuucaacuucuucuaccuggugccccccagaguggaggacaccguggagcccuucagccugcccgaccugagaguggacgagaugagcagcagcagauggcagaaccccguggugaugcugcaggccgaccccaaccagaacaucgccgcccacuggcagaacggcagaugcaccaucaacggcgagcugcugggcaccacccccagaaaccagagcuggcugcugagaaugagaggcagcgugcuggccgcccccggcggccagaaggccgugaccgugaacguggaccugaccgagcccgacggccaggccuucagcgugcugagcggcaaccccggccccgagggcgugcccgacuuccaggccaucuacaacgugagaaugagcaccgccagcaccaccgccggccacaccguggccaccaacggcuacaucgagcagagcggcuacacccccgcccugggcacccuggugauccagggcguggaccugagccaggugcccgcccugggcagcgaggugaccaugcagguggugagcaucgaccugaaccacaacauggaccccaccagacugcccgacuacaacggcgccggcuucgacggcagcguggcccuggcccccccccuggugcccccccugcccggcgaggugcugcugagauucaccacccugcccaucaccaccagcagaggcagcagcgugagcgccacccuggacugcgcccugcccgccgaguggaucaccugguuccuggugcacaacuucgugccccagggcgacgccgcccugcugagauacagaaacagaggcaccggccagauccuguucgagugcaagcuguacaaggagggcuuccuggccguggccggcgugagcaccagaaccguguuccccaccagcggcguguucgaguucgugagcugggugcccguguucuaccagcugacccccgugggcagcagcggcgccagaaagagacagagauga

SEQ ID NO: 22911 - RNA, 1623 nt, Artificial Sequence
  derived and/or modified sequence opt4 from VP1__Norovirus__AIG59994
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaucggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagccguguga

SEQ ID NO: 22912 - RNA, 1623 nt, Artificial Sequence
  derived and/or modified sequence opt4 from VP1__Norovirus__AIG59996
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagccguguga

SEQ ID NO: 22913 - RNA, 1623 nt, Artificial Sequence; identical to SEQ ID NO: 22675
  derived and/or modified sequence opt4 from VP1__Norovirus__AIG59998

SEQ ID NO: 22914 - RNA, 1623 nt, Artificial Sequence
  derived and/or modified sequence opt4 from VP1__Norovirus__AIG60000
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggccacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagccguguga

SEQ ID NO: 22915 - RNA, 1623 nt, Artificial Sequence
  derived and/or modified sequence opt4 from VP1__Norovirus__AIG60002
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgccgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgacagagacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaucaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22916 - RNA, 1623 nt, Artificial Sequence; identical to SEQ ID NO: 22675
  derived and/or modified sequence opt4 from VP1__Norovirus__AIG60004

SEQ ID NO: 22917 - RNA, 1623 nt, Artificial Sequence; identical to SEQ ID NO: 22675
  derived and/or modified sequence opt4 from VP1__Norovirus__AIG60006

SEQ ID NO: 22918 - RNA, 1623 nt, Artificial Sequence
  derived and/or modified sequence opt4 from VP1__Norovirus__AIG60008
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22919 - RNA, 1623 nt, Artificial Sequence; identical to SEQ ID NO: 22729
  derived and/or modified sequence opt4 from VP1__Norovirus__AIG60010

SEQ ID NO: 22920 - RNA, 1623 nt, Artificial Sequence; identical to SEQ ID NO: 22675
  derived and/or modified sequence opt4 from VP1__Norovirus__AIG60012

SEQ ID NO: 22921 - RNA, 1623 nt, Artificial Sequence
  derived and/or modified sequence opt4 from VP1__Norovirus__AIG60014
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagccguguga

SEQ ID NO: 22922 - RNA, 1623 nt, Artificial Sequence; identical to SEQ ID NO: 22723
  derived and/or modified sequence opt4 from VP1__Norovirus__AIG60016

SEQ ID NO: 22923 - RNA, 1623 nt, Artificial Sequence; identical to SEQ ID NO: 22675
  derived and/or modified sequence opt4 from VP1__Norovirus__AIG60018

SEQ ID NO: 22924 - RNA, 1623 nt, Artificial Sequence
  derived and/or modified sequence opt4 from VP1__Norovirus__AIG60020
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcaucgugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22925 - RNA, 1623 nt, Artificial Sequence; identical to SEQ ID NO: 22675
  derived and/or modified sequence opt4 from VP1__Norovirus__AIG60022

SEQ ID NO: 22926 - RNA, 1623 nt, Artificial Sequence; identical to SEQ ID NO: 22729
  derived and/or modified sequence opt4 from VP1__Norovirus__AIG60024

SEQ ID NO: 22927 - RNA, 1629 nt, Artificial Sequence
  derived and/or modified sequence opt4 from VP1__Norovirus__AII73717
augaagauggccagcaacgacgccgcccccagcaacgacggcgccgccagccuggugcccgagggcaucaacgagaccaugccccuggagcccguggccggcgccagcaucgccgcccccguggccggccagaccaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccaucccccccaacuuccccguggacaugaucagccccgcccagaucaccaugcugccccaccugaucguggacgugagaacccuggagcccaucaugaucccccugcccgacgugagaaacguguucuaccacuucaacaaccagccccagcccagaaugagacugguggccaugcuguacaccccccugagaagcaacggcagcggcgacgacguguucaccgugagcugcagagugcugaccagacccacccccgacuucgaguucaucuaccuggugccccccagcguggagagcaagaccaagcccuucacccugcccauccugaccaucagcgagcugaccaacagcagauuccccauccccaucgagcagcuguacaccgcccccaacgagaccaacguggugcagugccagaacggcagaugcacccuggacggcgagcugcagggcaccacccagcugcugagcagcgccgugugcagcuacagaggcagaaccguggccaacaacggcgacaacugggaccagaaccugcugcagcugaccuaccccaacggcgccagcuacgaccccaccgacgaggugcccgccccccugggcacccaggacuucagcggcaugcuguacggcgugcugacccaggacaacgugaacgugagcaccggcgaggccaagaacgccaagggcaucuacaucagcaccaccagcggcaaguucacccccaagaucggcagcaucggccugcacagcaucaccgagcacgugcaccccaaccagcagagcagauucacccccgugggcguggccgugaacgagaacacccccuuccagcagugggugcugccccacuacgccggcagccuggcccugaacaccaaccuggcccccgccguggcccccaccuuccccggcgagcagcugcuguucuucagaagcagagugcccugcgugcagggccugcagggccaggacgccuucaucgacugccugcugccccaggagugggugaaccacuucuaccaggaggccgcccccagccaggccgacguggcccugaucagauacgugaaccccgacaccggcagaacccuguucgaggccaagcugcacagaagcggcuucaucaccgugagccacaccggcgccuacccccugguggugccccccaacggccacuucagauucgacagcugggugaaccaguucuacagccuggcccccaugggcaccggcaacggcagaagaagaauccaguga

SEQ ID NO: 22928 - RNA, 1623 nt, Artificial Sequence
  derived and/or modified sequence opt4 from VP1__Norovirus__AII73720
augaagauggccagcaacgacgccacccccagcaacgacggcgccgccggccuggugcccgagagcaacaacgaggccauggcccuggagcccguggugggcgccagccuggccgcccccgugaccggccagaccaacaucaucgaccccuggaucagaaccaacuucgugcaggcccccaacggcgaguucaccgugagccccagaaacagccccggcgagauccuggugaaccuggagcugggccccgagcugaaccccuaccuggcccaccuggccagaauguacaacggcuacgccggcggcauggaggugcaggugaugcuggccggcaacgccuucaccgccggcaagaucaucuucgccgccgugccccccuacuuccccguggagaaccugagccccagccagaucaccauguucccccacgugaucguggacgugagaacccuggagcccgugcugcugcccaugcccgacgugagaagcacccuguuccacuucaaccagaaggacgagcccaagaugagacugguggccaugcuguacaccccccugagaagcaacggcagcggcgacgacguguucaccgugagcugcagaauccugaccagacccagccccgaguucgacuucaccuaccuggugccccccaccguggagagcaagaccaagcccuucacccugcccgugcugacccugggcgagcugagcaacagcagauucccccugagcaucgacgagauggugaccagccccaacgagagcaucguggugcagccccagaacggcagagugacccuggacggcgagcugcugggcaccacccagcugcaggccugcaacaucugcagcaucagaggcaaggugaccggccaggugcccaacgagcagcacauguggaaccuggagaucaccaaccugaacggcacccaguucgaccccaccgacgacgugcccgccccccugggcgugcccgacuucgccggcgagguguucggcgugcugagccagagaaacagaggcgagagcaaccccgccaacagagcccacgacgccgugguggccaccuacagcgacaaguacacccccaagcugggccuggugcagaucggcaccuggaacaccaacgacguggagaaccagcccaccaaguucacccccaucggccugaacgagguggccaacggccacagauucgagcaguggacccugcccagauacagcggcgcccugacccugaacaugaaccuggcccccgccguggccccccuguuccccggcgagagacugcuguucuucagaagcuacgugccccugaagggcggcuucggcaaccccgccaucgacugccuggugccccaggagugggugcagcacuucuaccaggagagcgcccccagccugggcgacguggcccuggugagauacgugaaccccgacaccggcagagugcuguucgaggccaagcugcacaagggcggcuuccugaccgugagcagcaccagcaccggccccgugguggugcccgccaacggcuacuucagauucgacagcugggugaaccaguucuacagccuggcccccaugggcaccggcaacggcagaagaagauuccaguga

SEQ ID NO: 22929 - RNA, 1611 nt, Artificial Sequence
  derived and/or modified sequence opt4 from VP1__Norovirus__AII73723
augaagauggccagcaacgacgccacccccagcgacgacggcgccgccggccuggugcccgagaucaacagcgaggugauggcccuggagcccguggccggcgccagcaucgccgcccccguggugggccagcagaacaucaucgaccccuggaucagaaacaacuucgugcaggcccccgccggcgaguucaccgugagccccagaaacagccccggcgagcugcugcuggaccuggagcugggccccgagcugaaccccuaccuggcccaccuggccagaauguacaacggccacgccggcggcauggaggugcagaucgugcuggccggcaacgccuucaccgccggcaagauccuguucgccgccaucccccccagcuuccccuacgagaaccugagccccgcccagcugaccaugugcccccacgugaucguggacgugagacagcuggagcccgugcugcugcccaugcccgacaucagaaacguguucuaccacuacaaccagaacaacagccccaagcugagacugguggccaugcuguacaccccccugagagccaacaacagcggcgacgacguguucaccgugagcugcagagugcugaccagacccagccccgacuuccaguucaccuuccuggugccccccaccguggagagcaagaccaagaacuucacccugcccgugcugagagugagcgagaugaccaacagcagauuccccguggugcuggaccagauguacaccagcagaaacgagaacaucaucgugcagccccagaacggcagaugcaccaccgacggcgagcugcugggcaccaccauccugcagagcgugagcaucugcaacuucaagggcaccaugcaggccaagcugaacgaggagcccagauaccagcugcagcugaccaaccuggacggcagccccaucgaccccaccgacgacaugcccgccccccugggcacccccgacuuccaggccgugcuguacggcguggccagccagagaagcagcagagacaacgccaccagagcccacgacgcccagaucgacaccgccggcgacaccuucgcccccaagaucggccaggugagauucaagagcagcagcaacgacuucgaccugcacgaccccaccaaguucacccccaucggcgugaacguggacgaccagcaccccuucagacaguggagccugcccaacuacggcggccaccuggcccugaacaaccaccuggcccccgccgugaccccccuguuccccggcgagcagauccuguucuucagaagcuacauccccagcgccggcggccacaccgacggcgccauggacugccugcugccccaggaguggguggagcacuucuaccaggaggccgcccccagccagagcgacaucgcccuggugagauucaucaaccccgacaccggcagagugcuguucgaggccaagcugcacaagcagggcuuccugaccaucgccgccagcggcgaccaccccaucgugaugcccaccaacggcuacuucagauucgaggccugggugaaccccuucuacacccuggcccccgugggcaccggcagcggcagaagaagaauccaguga

SEQ ID NO: 22930 - RNA, 1623 nt, Artificial Sequence; identical to SEQ ID NO: 22675
  derived and/or modified sequence opt4 from VP1__Norovirus__AII73726

SEQ ID NO: 22931 - RNA, 1623 nt, Artificial Sequence; identical to SEQ ID NO: 22675
  derived and/or modified sequence opt4 from VP1__Norovirus__AII73729

SEQ ID NO: 22932 - RNA, 1623 nt, Artificial Sequence; identical to SEQ ID NO: 22675
  derived and/or modified sequence opt4 from VP1__Norovirus__AII73732

SEQ ID NO: 22933 - RNA, 1608 nt, Artificial Sequence
  derived and/or modified sequence opt4 from VP1__Norovirus__AII73735
augaagauggccagcagcgacgccgcccccagcaacgacggcgccgccggccuggugcccgaggccaacaacgagaccauggcccuggagcccguggccggcgccagcaucgccgccccccugaccggccagaacaacaucaucgaccccuggaucagacugaacuucgugcaggcccccaacggcgaguucaccgugagccccagaaacagccccggcgaggugcugcugaaccuggagcugggccccgagcugaaccccuaccuggcccaccugagcagaauguacaacggcuacgccggcggcguggaggugcaggugcugcuggccggcaacgccuucaccgccggcaagcugguguucgccgccgugcccccccacuucccccuggagaacaucagccccggccagaucaccauguucccccacgugaucaucgacgugagaacccuggagcccgugcugcugccccugcccgacgugagaaacaacuucuuccacuacaaccagcagaacgagcccagaaugagacugguggccaugcuguacaccccccugagaagcaacggcagcggcgacgacguguucaccgugagcugcagagugcugaccagacccagccccgacuucgacuucaacuaccuggugccccccaccguggagagcaagaccaagcccuucacccugcccauccugaccaucggcgagcugaccaacagcagauuccccgugcccaucgacgagcuguacaccagccccaacgagagccugguggugcagccccagaacggcagaugcgcccuggacggcgagcugcagggcaccacccagcugcugcccaccgccaucugcagcuucagaggcagaaucaaccagaaggugagcggcgagaaccacguguggaacaugcaggugaccaacaucaacggcacccccuucgaccccaccgaggacgugcccgccccccugggcacccccgacuucagcggcaagcuguucggcgugcugagccccagagaccacgacaacgccugcagaagccacgacgccgugaucgccaccaacagcgccaaguucacccccaagcugggcgccauccagaucggcaccugggaggagaacgacgugcacaucaaccagcccaccaaguucacccccgugggccuguucgaggacgagggcuucaaccaguggacccugcccaacuacagcggcgcccugacccugaacaugggccuggccccccccguggcccccaccuuccccggcgagcagauccuguucuucagaagccacaucccccugaagggcggcguggccgaccccgugaucgacugccugcugccccaggaguggauccagcaccuguaccaggagagcgcccccagccagagcgacguggcccugaucagauucaccaaccccgacaccggcagagugcuguucgaggccaagcugcacagaagcggcuacaucaccguggccaacaccggcagcagacccaucguggugcccgccaacggcuacuucagauucgacagcugggugaaccaguucuacagccuggcccccaugggcaccggcaacggcagaagaagagugcaguga

SEQ ID NO: 22934 - RNA, 1623 nt, Artificial Sequence; identical to SEQ ID NO: 22729
  derived and/or modified sequence opt4 from VP1__Norovirus__AII73738

SEQ ID NO: 22935 - RNA, 1620 nt, Artificial Sequence
  derived and/or modified sequence opt4 from VP1__Norovirus__AII73741
augaagauggccagcaacgacgccgcccccagcaacgacggcgccaccggccuggugcccgagaucaacaccgagacccugccccuggagcccguggccggcgccgccaucgccgcccccgugaccggccagaacaacaucaucgaccccuggaucagaaacaacuucgugcaggcccccaacggcgaguucaccgugagccccagaaacagccccggcgagauccugaugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggacaugcugagccccgcccagaucaccaugcugccccaccugaucguggacgugagaacccuggagcccaucaugaucccccugcccgacgugagaaacguguucuaccacuucaacaaccagcccgcccccagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucacccugcccauccugaccaucggcgagcugaccaacagcagauuccccgcccccaucgaccagcuguacaccagccccaacgccgacaucguggugcagccccagaacggcagaugcacccuggacggcgagcugcagggcaccacccagcugcugaccaccgccaucugcagcuacagaggcaugaccagcaaccccaccagcgacuacugggacgaccaccugcugcaccuggugcaccccaacggcgccaccuacgaccccaccgaggacgugcccgcccccuucggcacccaggacuucagaggcauccuguacggcaugcugacccagaaccccagaaccagcggcgacgaggccgccaacagccacggcaucuacaucagcagcaccagcgagaaguucacccccaagcugggcaccaucggccugcaccaggugcagggcgacaucgccagcaaccagcagagcaaguucacccccgugggcaucgccgugaacggcaacacccccuucagacagugggagcugcccaacuacagcggcgcccugacccugaacaccaaccuggcccccgccgugggccccaacuuccccggcgagcagauccuguucuucagaagcaacgugcccagcgugcagggcggccagcccaucgagaucgacugccugaucccccaggagugggugagccacuucuaccaggagagcgcccccagccagagcgacguggcccuggugagauacgugaaccccgacaccggcagaaccaucuucgaggccaagcugcacagacagggcuucaucaccaucgccgccaccggcagcaaccccgugguggugccccccaacggcuacuucagauucgacagcugggugaaccaguucuacgcccuggcccccaugggcaccggcaacggcagaagaagagugcaguga

SEQ ID NO: 22936 - RNA, 1623 nt, Artificial Sequence; identical to SEQ ID NO: 22072
  derived and/or modified sequence opt4 from VP1__Norovirus__AII73744

SEQ ID NO: 22937 - RNA, 1623 nt, Artificial Sequence
  derived and/or modified sequence opt4 from VP1__Norovirus__AII73747
augaagauggccagcaacgacgccgcccccagcaacgacggcgccaccggccuggugcccgagaucaacaacgagacccugccccuggagcccguggccggcgccgccaucgccgcccccgugaccggccagaacaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacaacaaccagcccgccaacagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucagccugcccauccugaccaucagcgagcugaccaacagcagauuccccgcccccaucgacagccuguucaccgcccagaacaacaaccugaacgugcagugccagaacggcagaugcacccuggacggcgagcugcagggcaccacccagcugcugcccagcggcaucugcgccuucagaggcagacugaccgccgacguggacggcagccacgacgacagauggcacaugcagcugaccaaccugaacggcacccccuucgaccccaccgaggacgugcccgccccccugggcacccccgacuucaccggccugcuguucggcguggccagccagagaaacgugggcagcaaccccaacaccaccagagcccacgaggccgugaucagcaccaccagcagccaguucgugcccaagcugggcagcgugaacuucggcagcaccagcaccgacuuccagcugcagcagcccaccaaguucacccccgugggcaucaagaucgagagcggccacgaguucgaccagugggcccugcccagauacagcggccaccugacccugaacaugaaccuggccccccccaucgcccccaacuuccccggcgagcagcugcuguucuucagaagcaacgugcccugcgccggcggcgugagcgacggcgugaucgacugccugcugccccaggaguggauccagcacuucuaccaggagagcgcccccagccagagcgacguggcccugaucagauacgugaaccccgacaccggcagaacccuguucgaggccaagcugcacagaaccggcuacaucaccguggcccacagcggcgacuacccccugguggugcccagcaacggcuacuucagauucgacagcugggugaaccaguucuacagccuggcccccaugggcaccggcaacggcagaagaagagugcaguga

SEQ ID NO: 22938 - RNA, 1623 nt, Artificial Sequence
  derived and/or modified sequence opt4 from VP1__Norovirus__AII73750
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggccacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22939 - RNA, 1623 nt, Artificial Sequence
  derived and/or modified sequence opt4 from VP1__Norovirus__AII73753
augaagauggccagcaacgacgccacccccagcaacgacggcgccgccggccuggugcccgagagcaacaacgaggccauggcccuggagcccguggugggcgccagccuggccgcccccgugaccggccagaccaacaucaucgaccccuggaucagaaccaacuucgugcaggcccccaacggcgaguucaccgugagccccagaaacagccccggcgagauccuggugaaccuggagcugggccccgagcugaaccccuaccuggcccaccuggccagaauguacaacggcuacgccggcggcauggaggugcaggugaugcuggccggcaacgccuucaccgccggcaagaucaucuucgccgccgugccccccuacuuccccguggagaaccugagccccagccagaucaccauguucccccacgugaucaucgacgugagaacccuggagcccgugcugcugcccaugcccgacgugagaagcacccuguuccacuucaaccagaaggacgagcccaagaugagacugguggccaugcuguacaccccccugagaagcaacggcagcggcgacgacguguucaccgugagcugcagaauccugaccagacccagccccgaguucgacuucaccuaccuggugccccccaccguggagagcaagaccaagcccuucacccugcccgugcugacccugggcgagcugagcaacagcagauucccccugagcaucgacgagauggugaccagccccaacgagagcaucguggugcagccccagaacggcagagugacccuggacggcgagcugcugggcaccacccagcugcaggccugcaacaucugcagcaucagaggcaaggugaccggccaggugcccaacgagcagcacauguggaaccugcagaucaccaaccugaacggcacccaguucgaccccaccgacgacgugcccgccccccugggcgugcccgacuucgccggcgagguguucggcgugcugagccagagaaacagaggcgagagcaaccccgccaacagagcccacgacgccgugguggccaccuacagcgacaaguacacccccaagcugggccuggugcagaucggcaccuggaacaccaacgacguggagaaccagcccaccaaguucacccccaucggccugaacgagguggccaacggccacagauucgagcaguggacccugcccagauacagcggcgcccugacccugaacaugaaccuggcccccgccguggccccccuguuccccggcgagagacugcuguucuucagaagcuacgugccccugaagggcggcuucggcaaccccgccaucgacugccuggugccccaggagugggugcagcacuucuaccaggagagcgcccccagccugggcgacguggcccuggugagauacgugaaccccgacaccggcagagugcuguucgaggccaagcugcacaagggcggcuuccugaccgugagcagcaccagcaccggccccgugguggugcccgccaacggcuacuucagauucgacagcugggugaaccaguucuacagccuggcccccaugggcaccggcaacggcagaagaagauuccaguga

SEQ ID NO: 22940 - RNA, 1623 nt, Artificial Sequence; identical to SEQ ID NO: 22072
  derived and/or modified sequence opt4 from VP1__Norovirus__AII73756

SEQ ID NO: 22941 - RNA, 1668 nt, Artificial Sequence
  derived and/or modified sequence opt4 from VP1__Norovirus__AII73759
augagaauggccagcagcgacgcccccgugagcggcaccgacggcgccgccggccuggugcccgagagccagcaggaggugcugccccuggagcccguggccggcgugcagcuggccgcccccguggccggccagagcaacaucaucgaccccuggaucagaaugaacuucgugcaggcccccgccggcgaguucaccgugagccccagaaacgcccccggcgaggugcugaucgaccuggagcugggccccgagcugaaccccuaccugaaccaccuggccagaauguacaacggcuacgugggcggcauggagguggagguggugcuggccggcaacgccuucaccgccggcaagauccuguucgccgccgugccccccagcuuccccacccacggcaucagcgccgcccaggccaccaugcugccccacgugaucguggacgugagacagcuggagcccgugagacugccccugcccgacgugagaaacgugauguuccacuucugccaggagaacaaggagcccagaaugagaaucguggccauccuguacaccccccugagagccaacggcgccggcgacgacguguucaccgugagcugcagagugcugaccagacccagccccgacuucgacuucaucuuccuggugccccccagcguggagagcaagcugaagcaguucacccugcccaaccugcagcccaacgagaugaccaacagcagauuccccaccggcaucacccagcuguacaccagccccaacaccaaccugguggugcaguuccagaacggcagaugccugcuggacggcacccugcugggcaccacccccgugagagccgccgacaucugcagcuucagaggcgugaccagcaccgagguggacgccaccgacagccccagaguggccggcagccacagaaucauggugcagcugagagagcccgacggcgaggaguucagccccaccggccccaaccccgcccccgugggcacccccgacuuccaggccgccaucuucggcacccugagccagagaaacaccggcggcgccggccagaacagcaacagagcccacuucgccuacuucuacaccagaaaccccaccuucgcccccggcaucggcaccgugguguucagcuucgacaccaccgacuuccagaacagacagcccaccaaguucagccccagcggcguguucgacgacgacagcagcgagcccuucaaccaguucagccugcccuacuacaacggcagccugggcgccguggacgccggcaagcuggccccccccguggcccccaacuaccccggcgagcagauccuguacuucagaggcagcgugcccuucaagggcggcuacggcgagggcgagaucgacagccugcugccccaggaguggaucacccacuucuacgccgagcaggcccccacccagggcgacgccgcccugcugagauacuacaaccccgacaccggcagagugcuguucgagugcaagcugcacagagagggcuucaucaccaucaacuacaccggcagcaacgcccuggccgugcccgugaacggcguguucagauucgagggcugggugaacaaguucuacacccugacccccaugggcaacggcaacggcagaagaggcagaagaagagagcuguga

SEQ ID NO: 22942 - RNA, 1668 nt, Artificial Sequence
  derived and/or modified sequence opt4 from VP1__Norovirus__AII73762
augaagauggccagcaaggacgccagccccagcaccgacggcaccgccaaccuggugcccgagagccagcaggaggugcuggcccugcagcccguggccggcgcccagaucgccgcccccguggccggccaguucaacgugaucgaccccuggaucuaccagaacuucgugcaggcccccgagggcgaguucaccgugagccccagaaacagcaccggcgagauccugaugaaccuggagcugggcccccagcugaaccccuaccuggcccaccuggccagaauguacaacgccuacgccggcggcuucgaggugcaggugcugcuggccggcaacgccuucaccgccggcaagaucaucgugugcgccgugccccccaacuucccccugcagaacaucagcgccgcccaggccacccagcugccccacguggugguggacgugagacagcuggagcccguggugcugccccugcccgacgugagagccggcuucuaccacuacaaccagguggaggagagcagaaugagacugguggccauccuguacaccccccugagaaccaacagcgccggcgacgacgccuucaccgugagcugcagaauccugaccagacccgcccccgacuucagcuucuucuuccugaucccccccaccaucgagagcaagaccacccccuucacccugcccagacugcccaucagcgagaugaccaacagcagauucccccuggugaucaagggcauggugguggaccccaaccugccccugcaggccaacuuccagaacggcagaaucacccuggacggcgagcugcagggcaccacccugcccaccagcaccagcaucggcagaaucagcggcacccacaugagcagcacccccagcagaaucauccagcacgaggacagcggcgacagcacccagcccagaguguucaaccccguguggauggaccugaccgagaacaacuggaccgaguuccagcccuucaacgaccagcccgccccccugggcugccccgacuucaaggccaagauccugggcacccugaucagacagcccaacaacggcagcuacuacuucgacgccuaccuggacaccagacagcacggcaccuucgcccccuacaccggccacgccgccgugcacagcgaccagcaggccggccaccuggcccagggcuacaagauccaguucagccccaccggcaucgagagcgaccagaacaccgaccugaaccagcugcccgacuacggcggcgccaugaccgugagcaagggccuggcccccgccgccgcccccgacuuccccggcgagaugauccuguacuucgugagcgacaugcccgugagaaaccccaacggcgagagaagagacaccgagauccugugccugcugccccaggagauggugacccacuucuacgagcagcaggcccccagccagggcgacguggcccuggugagauacaucaacgccgagaccggcagagugauguucgagggcaagcugcacagaaacggcuucuucaccgugagcgccaccgccagaacccugaucgugcccgacggcuacuucagauucgacagcugggugaacagauucuacacccugagccccaugggcaccggcaacggcagaagaagagccagaaugcuggaguga

SEQ ID NO: 22943 - RNA, 1638 nt, Artificial Sequence
  derived and/or modified sequence opt4 from VP1__Norovirus__AII73765
augaugauggccagcaaggacgcccccaccaacauggacggcaccagcggcgccggccagcuggugcccgaggccaacaccgccgagcccaucagcauggagcccguggccggcgccgccaccgccgccgccaccgccggccaggugaacaugaucgaccccuggaucaugaacaacuacgugcaggccccccagggcgaguucaccaucagccccaacaacacccccggcgacauccuguucgaccugcagcugggcccccaccugaaccccuuccugagccaccuggcccagauguacaacggcugggugggcaacaugaaggugaaggugcugcuggccggcaacgccuucaccgccggcaagaucaucaucagcugcaucccccccggcuucguggcccagaacgugagcaucgcccaggccaccauguucccccacgugaucgccgacgugagagugcuggagcccaucgaggugccccuggaggacgugagaaacgugcuguuccacaacaacgacaacacccccaccaugagacuggugugcaugcuguacaccccccugagagccagcggcagcagcagcggcaccgaccccuucgugaucgccggcagagugcugaccugccccagccccgacuucagcuuccuguuccuggugccccccaacguggagcagaagaccaagcccuucagcgugcccaaccugccccugaacacccugagcaacagcagagugcccagccugaucaagagcaugauggugagcagagaccacggccagauggugcaguuccagaacggcagagugacccuggacggccagcugcagggcaccacccccaccagcgccagccagcugugcaagaucagaggcagcguguuccacgccaacggcggcaacggcuacaaccugaccgagcuggacggcagccccuaccacgccuucgagagccccgcccccaucggcuuccccgaccugggcgagugcgacuggcacauggaggccagccccaccacccaguucaacaccggcgacgugaucaagcagaucaacgugaagcaggagagcgccuucgccccccaccugggcaccauccaggccgacggccugagcgacgugagcgugaacaccaacaugaucgccaagcugggcugggugagccccgugagcgacggccacaagggcgacguggaccccugggugauccccagauacggcagcacccugaccgaggccgcccagcuggccccccccaucuacccccccggcuucggcgaggccaucguguucuucaugagcgacuuccccaucgcccacggcaccaacggccugagcgugcccugcaccaucccccaggaguucgugacccacuucgugaacgagcaggcccccaccagaggcgaggccgcccugcugcacuaccuggaccccgacacccacagaaaccugggcgaguucaagcuguaccccgacggcuucaugaccugcgugcccaacagcagcggcaccggcccccagacccugcccaucaacggcguguucguguucgugagcugggugagcagauucuaccagcugaagcccgugggcaccgccggccccgccagaagacugggcaucagaagaagcuga

SEQ ID NO: 22944 - RNA, 1623 nt, Artificial Sequence; identical to SEQ ID NO: 22675
  derived and/or modified sequence opt4 from VP1__Norovirus__AII73768

SEQ ID NO: 22945 - RNA, 1608 nt, Artificial Sequence
  derived and/or modified sequence opt4 from VP1__Norovirus__AII73771
augaagauggccagcagcgacgccgcccccagcaacgacggcgccgccggccuggugcccgaggccaacaacgagaccauggcccuggagcccguggccggcgccagcaucgccgccccccugaccggccagaacaacaucaucgaccccuggaucagacugaacuucgugcaggcccccaacggcgaguucaccgugagccccagaaacagccccggcgaggugcugcugaaccuggagcugggccccgagcugaaccccuaccuggcccaccugagcagaauguacaacggcuacgccggcggcguggaggugcaggugcugcuggccggcaacgccuucaccgccggcauccugguguucgccgccgugcccccccacuucccccuggagaacaucagccccggccagaucaccauguucccccacgugaucaucgacgugagaacccuggagcccgugcugcugccccugcccgacgugagaaacaacuucuuccacuacaaccagcagaacgagcccagaaugagacugguggccaugcuguacaccccccugagaagcaacggcagcggcgacgacguguucaccgugagcugcagagugcugaccagacccagccccgacuucgacuucaacuaccuggugccccccaccguggagagcaagaccaagcccuucacccugcccauccugaccaucggcgagcugaccaacagcagauuccccgugcccaucgacgagcuguacaccagccccaacgagagccugguggugcagccccagaacggcagaugcgcccuggacggcgagcugcagggcaccacccagcugcugcccaccgccaucugcagcuucagaggcagaaucaaccagaaggugagcggcgagaaccacguguggaacaugcaggugaccaacaucaacggcacccccuucgaccccaccgaggacgugcccgccccccugggcacccccgacuucagcggcaagcuguucggcgugcugagccagagagaccacgacaacgccugcagaagccacgacgccgugaucgccaccaacagcgccaaguucacccccaagcugggcgccauccagaucggcaccugggagcaggacgacgugcacaucaaccagcccaccaaguucacccccgugggccuguucgagaacgagggcuucaaccaguggacccugcccaacuacagcggcgcccugacccugaacaugggccuggccccccccguggcccccaccuuccccggcgagcagauccuguucuucagaagccacaucccccugaagggcggcguggccgaccccgugaucgacugccugcugccccaggaguggauccagcaccuguaccaggagagcgcccccagccagagcgacguggcccugaucagauucaccaaccccgacaccggcagagugcuguucgaggccaagcugcacagaagcggcuacaucaccguggccaacaccggcagcagacccaucguggugcccgccaacggcuacuucagauucgacagcugggugaaccaguucuacagccuggcccccaugggcaccggcaacggcagaagaagagugcaguga

SEQ ID NO: 22946 - RNA, 1623 nt, Artificial Sequence
  derived and/or modified sequence opt4 from VP1__Norovirus__AII73774
augaagauggccagcaacgacgccgcccccagcaacgacggcgccgccggccuggugcccgagaucaacaacgaggugaugccccuggagcccguggccggcgccagccuggccacccccguggugggccagcagaacaucaucgaccccuggaucagaaacaacuucgugcaggcccccgccggcgaguucaccgugagccccagaaacagccccggcgagauccugcuggaccuggagcugggccccgagcugaaccccuaccuggcccaccuggccagaauguacaacggccacgccggcggcauggaggugcagaucgugcuggccggcaacgccuucaccgccggcaagaucaucuucgccgccaucccccccggcuuccccuacgagaaccugagccccagccagaucaccaugugcccccacgugaucaucgacgugagacagcuggagcccgugcugcugcccaugcccgacaucagaaacaacuucuuccacuacaaccagggcaacgaccccaagcugagacugaucgccaugcuguacaccccccugagagccaacaacagcggcgacgacguguucaccgugagcugcagagugcugaccaagcccagccccgacuucgaguucaccuuccuggugccccccaccguggagagcaagaccaagcaguucacccugcccauccugaagaucagcgagaugaccaacagcagauuccccgugcccguggagaugauguacaccgccagaaacgagaaccagguggugcagccccagaacggcagagugacccuggacggcgagcugcugggcaccaccccccugcuggccgugaacaucugcaaguucaagggcgaggugaucgccaagaacggcgacgugagaagcuacagaauggacauggagaucaccaacaccgacggcacccccaucgaccccaccgaggacacccccggccccaucggcagccccgacuuccagggcauccuguucggcguggccagccagagaaacaagaacgagcagaaccccgccaccagagcccacgaggccaacaucaacaccggcggcgaccaguacgcccccaagcuggcccaggugaaguucuucagcgagagccaggacuucgaggugcaccagcccaccguguucacccccgugggcguggccggcgacaccagccaccccuucagacagugggugcugcccagauacggcggccaccugaccaacaacacccaccuggcccccgccguggccccccuguuccccggcgagcagauccuguucuucagaagccagauccccagcagcggcggccacgagcugggcuacauggacugccuggugccccaggagugggugcagcacuucuaccaggaggccgccaccgcccagagcgagguggcccugaucagauucaucaaccccgacaccggcagagugcuguucgaggccaagcugcacaagcagggcuucaucaccguggcccacaccggcgacaaccccaucgugaugccccccaacggcuacuucagauucgaggccugggugaaccaguucuacagccuggcccccgugggcaccggcaacggcagaagaagaauccaguga

SEQ ID NO: 22947 - RNA, 1623 nt, Artificial Sequence
  derived and/or modified sequence opt4 from VP1__Norovirus__AII73777
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccaguacgaccuggugaucccccccaacggcuacuucagauucgacagcugggugaaccaguucuacacccuggcccccaugggcaacggcaccggcagaagaagagccguguga

SEQ ID NO: 22948 - RNA, 1611 nt, Artificial Sequence
  derived and/or modified sequence opt4 from VP1__Norovirus__AII73780
augaagauggccagcaacgacgccacccccagcgacgacggcgccgccggccuggugcccgagaucaacagcgaggugauggcccuggagcccguggccggcgccagcaucgccgcccccguggugggccagcagaacaucaucgaccccuggaucagaaacaacuucgugcaggcccccgccggcgaguucaccgugagccccagaaacagccccggcgagcugcugcuggaccuggagcugggccccgagcugaaccccuaccuggcccaccuggccagaauguacaacggccacgccggcggcauggaggugcagaucgugcuggccggcaacgccuucaccgccggcaagauccuguucgccgccaucccccccagcuuccccuacgagaaccugagccccgcccagcugaccaugugcccccacgugaucguggacgugagacagcuggagcccgugcugcugcccaugcccgacaucagaaacguguucuaccacuacaaccagaacaacagccccaagcugagacugguggccaugcuguacaccccccugagagccaacaacagcggcgacgacguguucaccgugagcugcagagugcugaccagacccagccccgacuuccaguucaccuuccuggugccccccaccguggagagcaagaccaagaacuucacccugcccgugcugagagugagcgagaugaccaacagcagauuccccguggugcuggaccagauguacaccagcagaaacgagaacaccaucgugcagccccagaacggcagaugcaccaccgacggcgagcugcugggcaccaccauccugcagagcgugagcaucugcaacuucaagggcaccaugcaggccaagcugaacgaggagcccagauaccagcugcagcugaccaaccuggacggcagccccaucgaccccaccgacgacaugcccgccccccugggcacccccgacuuccaggccgugcuguacggcguggccagccagagaagcagcagagacaacgccaccagagcccacgacgcccagaucgacaccgccggcgacaccuucgcccccaagaucggccaggugagauucaagagcagcagcaacgacuucgaccugcacgaccccaccaaguucacccccaucggcgugaacguggacgaccagcaccccuucagacaguggagccugcccaacuacggcggccaccuggcccugaacaaccaccuggcccccgccgugaccccccuguuccccggcgagcagauccuguucuucagaagcuacauccccagcgccggcggccacaccgacggcgccauggacugccugcugccccaggaguggguggagcacuucuaccaggaggccgcccccagccagagcgacaucgcccuggugagauucaucaaccccgacaccggcagagugcuguucgaggccaagcugcacaagcagggcuuccugaccaucgccgccagcggcgaccaccccaucgugaugcccaccaacggcuacuucagauucgaggccugggugaaccccuucuacacccuggcccccgugggcaccggcagcggcagaagaagaauccaguga

SEQ ID NO: 22949 - RNA, 1632 nt, Artificial Sequence
  derived and/or modified sequence opt4 from VP1__Norovirus__AII73783
augaugauggccagcaaggacgcccccaccaacauggacggcaccagcggcgccggccagcuggugcccgaggccaacaccgccgagccccugcccaucaagcccguggccggcgccgccaccgccguggccaccgccggccaggugaacaugaucgaccccuggaucaugaacaacuucgugcaggccccccagggcgaguucaccaucagccccaacaacacccccggcgacauccuguucgaccugcagcugggcccccaccugaaccccuuccuggcccaccugagcagaauguacaacggcugggugggcaacaugcaggugagaaucaugcuggccggcaacgccuucagcgccggcaagaucaucgugugcugcaucccccccggcuucagcagccagagcaucagcaucgcccaggccaccauguucccccacgugaucgccgacgugagagugcuggagcccaucgacgugccccuggacgacgugagaaacgugcuguuccacaacaacgacaacccccagaccaugagacugcugugcaugcuguacaccccccugagaagcggcggcaccagcagcggcaccgaccccuucgugaucgccggcagagugcugaccugccccacccccgacuucagcuuccuguuccuggugccccccgacaucgagcagagaaccaagcccuucagcgugcccaacauccccaugaaccugaugagcaacagcagagugagcaugcugaucgacggcaugauggugagcaacgaccagaaccaggugccccaguuccagaacggcagagugacccuggacggccagcugcagggcaccaccaccgugagcgccgccugcguggccagaaugagaggcagaaucuucaacaacaacggcaacuacggcgugaaccugaccgagcuggacggcaaccccuaccacgccuucgacagccccgccccccugggcuuccccgacuucggcaacugcgaccugcacaugaccuucgugaagaucaaccccaacgagcugagcagcggcgaccccagcggcaagguggugauccacagcuacgacgccaccuucgccccccaccugggcaccgugaagcuggagaacgacgacgagcuggccagauucgugggcaaggagguggugcuggagcugaccugggugagcaacagagagggcgccacccugaaccugugggccgugcccaacuacggcagcagccugacccaggccagccagcuggccccccccaucuacccccccggcuucggcgaggccaucguguacuucaccagcaccuuccccaccgugagcaaccccaaggugcccugcacccugccccaggaguucgugagccacuucgugaacgagcaggcccccaccagaggcgacgccgcccugcugcacuacguggaccccgacacccacagaaaccugggcgaguucaagauguaccccgagggcuacaugaccugcgugcccaacgccggcggcggcccccagacccugcccaucaacggcguguucguguucaucagcugggugagcagauacuaccagcugaagcccgugggcaccgccggcgccgccagaagacugggccugagaagaagcuga

SEQ ID NO: 22950 - RNA, 1608 nt, Artificial Sequence
  derived and/or modified sequence opt4 from VP1__Norovirus__AII73786
augaagauggccagcagcgacgccgcccccagcaacgacggcgccgccggccuggugcccgaggccaacaacgagaccauggcccuggagcccguggccggcgccagcaucgccgccccccugaccggccagaacaacaucaucgaccccuggaucagacugaacuucgugcaggcccccaacggcgaguucaccgugagccccagaaacagccccggcgaggugcugcugaaccuggagcugggccccgagcugaaccccuaccuggcccaccugagcagaauguacaacggcuacgccggcggcguggaggugcaggugcugcuggccggcaacgccuucaccgccggcaagcugguguucgccgccgugcccccccacuucccccuggagaacaucagccccggccagaucaccauguucccccacgugaucaucgacgugagaacccuggagcccgugcugcugccccugcccgacgugagaaacaacuucuuccacuacaaccagcagaacgagcccagaaugagacugguggccaugcuguacaccccccugagaagcaacggcagcggcgacgacguguucaccgugagcugcagagugcugaccagacccagccccgacuucgacuucaacuaccuggugccccccaccguggagagcaagaccaagcccuucacccugcccauccugaccaucggcgagcugaccaacagcagauuccccgugcccaucgacgagcuguacaccagccccaacgagagccugguggugcagccccagaacggcagaugcgcccuggacggcgagcugcagggcaccacccagcugcugcccaccgccaucugcagcuucagaggcagaaucaaccagaaggugagcggcgagaaccacguguggaacaugcaggugaccaacaucaacggcacccccuucgaccccaccgaggacgugcccgccccccugggcacccccgacuucagcggcaagcuguucggcgugcugagccagagagaccacgacaacgccugcagaagccacgacgccgugaucgccaccaacagcgccaaguucacccccaagcugggcgccauccagaucggcaccugggaggagaacgacgugcacaucaaccagcccaccaaguucacccccgugggccuguucgaggacgagggcuucaaccaguggacccugcccaacuacagcggcgcccugacccugaacaugggccuggccccccccguggcccccaccuuccccggcgagcagauccuguucuucagaagccacaucccccugaagggcggcguggccgaccccgugaucgacugccugcugccccaggaguggauccagcaccuguaccaggagagcgcccccagccagagcgacguggcccugaucagauucaccaaccccgacaccggcagagugcuguucgaggccaagcugcacagaagcggcuacaucaccguggccaacaccggcagcagacccaucguggugcccgccaacggcuacuucagauucgacagcugggugaaccaguucuacagccuggcccccaugggcaccggcaacggcagaagaagagugcaguga

SEQ ID NO: 22951 - RNA, 1623 nt, Artificial Sequence
  derived and/or modified sequence opt4 from VP1__Norovirus__AIS40019
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcccgcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcgccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgacagagacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22952 - RNA, 1623 nt, Artificial Sequence; identical to SEQ ID NO: 22723
  derived and/or modified sequence opt4 from VP1__Norovirus__AIV43147

SEQ ID NO: 22953 - RNA, 1623 nt, Artificial Sequence; identical to SEQ ID NO: 22727
  derived and/or modified sequence opt4 from VP1__Norovirus__AIV43148

SEQ ID NO: 22954 - RNA, 1623 nt, Artificial Sequence; identical to SEQ ID NO: 22727
  derived and/or modified sequence opt4 from VP1__Norovirus__AIV43149

SEQ ID NO: 22955 - RNA, 1623 nt, Artificial Sequence
  derived and/or modified sequence opt4 from VP1__Norovirus__AIV43150
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22956 - RNA, 1623 nt, Artificial Sequence
  derived and/or modified sequence opt4 from VP1__Norovirus__AIV43151
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22957 - RNA, 1623 nt, Artificial Sequence; identical to SEQ ID NO: 22723
  derived and/or modified sequence opt4 from VP1__Norovirus__AIV43152

SEQ ID NO: 22958 - RNA, 1623 nt, Artificial Sequence; identical to SEQ ID NO: 22723
  derived and/or modified sequence opt4 from VP1__Norovirus__AIV43153

SEQ ID NO: 22959 - RNA, 1623 nt, Artificial Sequence; identical to SEQ ID NO: 22723
  derived and/or modified sequence opt4 from VP1__Norovirus__AIV43154

SEQ ID NO: 22960 - RNA, 1623 nt, Artificial Sequence; identical to SEQ ID NO: 22675
  derived and/or modified sequence opt4 from VP1__Norovirus__AIV43155

SEQ ID NO: 22961 - RNA, 1623 nt, Artificial Sequence
  derived and/or modified sequence opt4 from VP1__Norovirus__AIV43156
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcuggccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccaagaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22962 - RNA, 1623 nt, Artificial Sequence
  derived and/or modified sequence opt4 from VP1__Norovirus__AIV43159
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcuggccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22963 - RNA, 1623 nt, Artificial Sequence
  derived and/or modified sequence opt4 from VP1__Norovirus__AIV43160
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugauccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22964 - RNA, 1623 nt, Artificial Sequence; identical to SEQ ID NO: 22963
  derived and/or modified sequence opt4 from VP1__Norovirus__AIV43161

SEQ ID NO: 22965 - RNA, 1623 nt, Artificial Sequence; identical to SEQ ID NO: 22723
  derived and/or modified sequence opt4 from VP1__Norovirus__AIV43162

SEQ ID NO: 22966 - RNA, 1623 nt, Artificial Sequence; identical to SEQ ID NO: 22723
  derived and/or modified sequence opt4 from VP1__Norovirus__AIV43163

SEQ ID NO: 22967 - RNA, 1623 nt, Artificial Sequence; identical to SEQ ID NO: 22963
  derived and/or modified sequence opt4 from VP1__Norovirus__AIV43164

SEQ ID NO: 22968 - RNA, 1623 nt, Artificial Sequence
  derived and/or modified sequence opt4 from VP1__Norovirus__AIV43165
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaagcaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22969 - RNA, 1623 nt, Artificial Sequence
  derived and/or modified sequence opt4 from VP1__Norovirus__AIV43166
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22970 - RNA, 1623 nt, Artificial Sequence
  derived and/or modified sequence opt4 from VP1__Norovirus__AIV43167
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgagaccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22971 - RNA, 1623 nt, Artificial Sequence
  derived and/or modified sequence opt4 from VP1__Norovirus__AIV43171
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagccacaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccaaccacgacuucgaggccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22972 - RNA, 1623 nt, Artificial Sequence
  derived and/or modified sequence opt4 from VP1__Norovirus__AIV43172
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22973 - RNA, 1623 nt, Artificial Sequence
  derived and/or modified sequence opt4 from VP1__Norovirus__AIV43173
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagccacaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagaauccaguucgagaccgacaccaaccacgacuucgaggccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22974 - RNA, 1623 nt, Artificial Sequence
  derived and/or modified sequence opt4 from VP1__Norovirus__AIV43174
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22975 - RNA, 1623 nt, Artificial Sequence; identical to SEQ ID NO: 22974
  derived and/or modified sequence opt4 from VP1__Norovirus__AIV43175

SEQ ID NO: 22976 - RNA, 1623 nt, Artificial Sequence; identical to SEQ ID NO: 22723
  derived and/or modified sequence opt4 from VP1__Norovirus__AIV43176

SEQ ID NO: 22977 - RNA, 1623 nt, Artificial Sequence; identical to SEQ ID NO: 22918
  derived and/or modified sequence opt4 from VP1__Norovirus__AIV43177

SEQ ID NO: 22978 - RNA, 1623 nt, Artificial Sequence; identical to SEQ ID NO: 22972
  derived and/or modified sequence opt4 from VP1__Norovirus__AIV43178

SEQ ID NO: 22979 - RNA, 1623 nt, Artificial Sequence
  derived and/or modified sequence opt4 from VP1__Norovirus__AIV43179
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggacauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22980 - RNA, 1623 nt, Artificial Sequence
  derived and/or modified sequence opt4 from VP1__Norovirus__AIY27747
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22981 - RNA, 1623 nt, Artificial Sequence; identical to SEQ ID NO: 22974
  derived and/or modified sequence opt4 from VP1__Norovirus__AJA71387

SEQ ID NO: 22982 - RNA, 1623 nt, Artificial Sequence
  derived and/or modified sequence opt4 from VP1__Norovirus__AJA71388
augaagauggccagcagcgacgccaaccccagcgacggcagcgccgccaaccuggugcccgaggugaacaacgaggugcuggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagccacaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgacagagacuucgaggccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22983 - RNA, 1623 nt, Artificial Sequence; identical to SEQ ID NO: 22972
  derived and/or modified sequence opt4 from VP1__Norovirus__AJA71389

SEQ ID NO: 22984 - RNA, 1623 nt, Artificial Sequence
  derived and/or modified sequence opt4 from VP1__Norovirus__AJA71390
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggccugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22985 - RNA, 1623 nt, Artificial Sequence; identical to SEQ ID NO: 22723
  derived and/or modified sequence opt4 from VP1__Norovirus__AJA71392

SEQ ID NO: 22986 - RNA, 1623 nt, Artificial Sequence; identical to SEQ ID NO: 22727
  derived and/or modified sequence opt4 from VP1__Norovirus__AJA71393

SEQ ID NO: 22987 - RNA, 1623 nt, Artificial Sequence
  derived and/or modified sequence opt4 from VP1__Norovirus__AJA71394
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagccacaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaucggcagcgccgacuucgcccccaagcugggcagagugcaguucgagaccgacaccaaccacgacuucgaggccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcagagugaaccaguucuacacccuggcccccaugggcaacggcaccggcagaagaagagcccuguga

SEQ ID NO: 22988 - RNA, 1623 nt, Artificial Sequence; identical to SEQ ID NO: 22918
  derived and/or modified sequence opt4 from VP1__Norovirus__AJA71395

SEQ ID NO: 22989 - RNA, 1623 nt, Artificial Sequence
  derived and/or modified sequence opt4 from VP1__Norovirus__AJA71396
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggccuacaccggccagcacgaccuggugaucccccccaacggcuacuucagauucgacagcugggugaaccaguucuacacccuggcccccaugggcaacggcaccggcagaagaagagcccuguga

SEQ ID NO: 22990 - RNA, 1623 nt, Artificial Sequence
  derived and/or modified sequence opt4 from VP1__Norovirus__AJA71399
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgccguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22991 - RNA, 1623 nt, Artificial Sequence
  derived and/or modified sequence opt4 from VP1__Norovirus__AJA71400
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgacagagacuucgagaccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22992 - RNA, 1623 nt, Artificial Sequence
  derived and/or modified sequence opt4 from VP1__Norovirus__AJA71401
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacaucacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucggcaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22993 - RNA, 1623 nt, Artificial Sequence; identical to SEQ ID NO: 22727
  derived and/or modified sequence opt4 from VP1__Norovirus__AJA71402

SEQ ID NO: 22994 - RNA, 1623 nt, Artificial Sequence
  derived and/or modified sequence opt4 from VP1__Norovirus__AJA71403
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccaucgagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22995 - RNA, 1623 nt, Artificial Sequence; identical to SEQ ID NO: 22991
  derived and/or modified sequence opt4 from VP1__Norovirus__AJA71404

SEQ ID NO: 22996 - RNA, 1623 nt, Artificial Sequence
  derived and/or modified sequence opt4 from VP1__Norovirus__AJA71405
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagaccaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcauccccgacuucgugggcaagauccagggcaugcugacccagaccaccagaaccgacggcagcaccagaggccacaaggccaccguguacaccggcagcguggacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22997 - RNA, 1623 nt, Artificial Sequence
  derived and/or modified sequence opt4 from VP1__Norovirus__AJA71406
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 22998 - RNA, 1623 nt, Artificial Sequence
  derived and/or modified sequence opt4 from VP1__Norovirus__AJA71407
augaagauggccagcagcgacgccacccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagccacaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccaaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagccguguga

SEQ ID NO: 22999 - RNA, 1623 nt, Artificial Sequence; identical to SEQ ID NO: 22994
  derived and/or modified sequence opt4 from VP1__Norovirus__AJA71408

SEQ ID NO: 23000 - RNA, 1623 nt, Artificial Sequence; identical to SEQ ID NO: 22991
  derived and/or modified sequence opt4 from VP1__Norovirus__AJA71409

SEQ ID NO: 23001 - RNA, 1623 nt, Artificial Sequence
  derived and/or modified sequence opt4 from VP1__Norovirus__AJA71410
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagccacaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgacagagacuucgaggccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23002 - RNA, 1623 nt, Artificial Sequence; identical to SEQ ID NO: 22918
  derived and/or modified sequence opt4 from VP1__Norovirus__AJA71411

SEQ ID NO: 23003 - RNA, 1623 nt, Artificial Sequence
  derived and/or modified sequence opt4 from VP1__Norovirus__AJA71412
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagaccggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23004 - RNA, 1623 nt, Artificial Sequence; identical to SEQ ID NO: 22723
  derived and/or modified sequence opt4 from VP1__Norovirus__AJA71413

SEQ ID NO: 23005 - RNA, 1623 nt, Artificial Sequence; identical to SEQ ID NO: 22675
  derived and/or modified sequence opt4 from VP1__Norovirus__AJA71416

SEQ ID NO: 23006 - RNA, 1623 nt, Artificial Sequence
  derived and/or modified sequence opt4 from VP1__Norovirus__AJA71417
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccugaccagccagaacuggagcaacuacgaccccaccgaggagauccccgccccccugggcacccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23007 - RNA, 1623 nt, Artificial Sequence
  derived and/or modified sequence opt4 from VP1__Norovirus__AJA71418
augaagauggccagcagcgacgccagccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23008 - RNA, 1623 nt, Artificial Sequence; identical to SEQ ID NO: 23007
  derived and/or modified sequence opt4 from VP1__Norovirus__AJA71419

SEQ ID NO: 23009 - RNA, 1623 nt, Artificial Sequence; identical to SEQ ID NO: 22723
  derived and/or modified sequence opt4 from VP1__Norovirus__AJA71420

SEQ ID NO: 23010 - RNA, 1623 nt, Artificial Sequence; identical to SEQ ID NO: 22918
  derived and/or modified sequence opt4 from VP1__Norovirus__AJA71421

SEQ ID NO: 23011 - RNA, 1623 nt, Artificial Sequence; identical to SEQ ID NO: 22994
  derived and/or modified sequence opt4 from VP1__Norovirus__AJA71422

SEQ ID NO: 23012 - RNA, 1623 nt, Artificial Sequence
  derived and/or modified sequence opt4 from VP1__Norovirus__AJA71423
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcaugcugacccagaccaccagaaccgacggcagcaccagaggccacaaggccaccguguacaucggcggcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23013 - RNA, 1623 nt, Artificial Sequence
  derived and/or modified sequence opt4 from VP1__Norovirus__AJA71424
augaagauggccagcagcgacgccaaccccagcgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaaagagagcccuguga

SEQ ID NO: 23014 - RNA, 1623 nt, Artificial Sequence
  derived and/or modified sequence opt4 from VP1__Norovirus__AJA71425
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccgugccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagccacaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgacagagacuucgaggccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23015 - RNA, 1623 nt, Artificial Sequence
  derived and/or modified sequence opt4 from VP1__Norovirus__AJA71426
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcagcuacgaccccaccgaggagauccccgccccccugggcacccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23016 - RNA, 1623 nt, Artificial Sequence
  derived and/or modified sequence opt4 from VP1__Norovirus__AJA71427
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggggcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23017 - RNA, 1623 nt, Artificial Sequence; identical to SEQ ID NO: 23001
  derived and/or modified sequence opt4 from VP1__Norovirus__AJA71428

SEQ ID NO: 23018 - RNA, 1623 nt, Artificial Sequence
  derived and/or modified sequence opt4 from VP1__Norovirus__AJA71429
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucaucgugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagacccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgugaccaaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagaccggcuacgugaccguggcccacaccggccagcacgaccuggugaucccccccaacggcuacuucagauucgacagcugggugaaccaguucuacacccuggcccccaugggcaacggcaccggcagaagaagagugcuguga

SEQ ID NO: 23019 - RNA, 1623 nt, Artificial Sequence
  derived and/or modified sequence opt4 from VP1__Norovirus__AJA71430
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagccacaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccaaccacgacuucgacgccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23020 - RNA, 1623 nt, Artificial Sequence
  derived and/or modified sequence opt4 from VP1__Norovirus__AJA71456
augaagauggccagcagcgacgccaaccccagcgacggcagcgccgccaaccuggugcccgaggugaacaacgaggugauggcccuggagcccguggugggcgccaccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcauccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23021 - RNA, 1623 nt, Artificial Sequence
  derived and/or modified sequence opt4 from VP1__Norovirus__AJA71457
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccagcauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23022 - RNA, 1623 nt, Artificial Sequence
  derived and/or modified sequence opt4 from VP1__Norovirus__AJA71458
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagccacaacuacaccaugaaccuggccagccagaacuggagcaacuacgaccccgccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgacagagacuucgaggccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23023 - RNA, 1623 nt, Artificial Sequence
  derived and/or modified sequence opt4 from VP1__Norovirus__AJA71459
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcguggacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23024 - RNA, 1623 nt, Artificial Sequence; identical to SEQ ID NO: 22994
  derived and/or modified sequence opt4 from VP1__Norovirus__AJA71460

SEQ ID NO: 23025 - RNA, 1623 nt, Artificial Sequence; identical to SEQ ID NO: 22723
  derived and/or modified sequence opt4 from VP1__Norovirus__AJA71461

SEQ ID NO: 23026 - RNA, 1623 nt, Artificial Sequence; identical to SEQ ID NO: 22997
  derived and/or modified sequence opt4 from VP1__Norovirus__AJA71462

SEQ ID NO: 23027 - RNA, 1623 nt, Artificial Sequence; identical to SEQ ID NO: 23007
  derived and/or modified sequence opt4 from VP1__Norovirus__AJA71463

SEQ ID NO: 23028 - RNA, 1623 nt, Artificial Sequence; identical to SEQ ID NO: 23001
  derived and/or modified sequence opt4 from VP1__Norovirus__AJA71464

SEQ ID NO: 23029 - RNA, 1623 nt, Artificial Sequence; identical to SEQ ID NO: 23001
  derived and/or modified sequence opt4 from VP1__Norovirus__AJA71465

SEQ ID NO: 23030 - RNA, 1623 nt, Artificial Sequence
  derived and/or modified sequence opt4 from VP1__Norovirus__AJA71466
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaaccuggugcaggcccccggcggcgaguucaccgugagccccagaaacgcccccggcgagauccuguggagcgccccccugggccccgagcugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgacagagacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23031 - RNA, 1623 nt, Artificial Sequence
  derived and/or modified sequence opt4 from VP1__Norovirus__AJA71467
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccagauucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23032 - RNA, 1623 nt, Artificial Sequence
  derived and/or modified sequence opt4 from VP1__Norovirus__AJA71470
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcauccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23033 - RNA, 1623 nt, Artificial Sequence
  derived and/or modified sequence opt4 from VP1__Norovirus__AJA71471
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgagcugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgacagagacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacagagaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23034 - RNA, 1623 nt, Artificial Sequence
  derived and/or modified sequence opt4 from VP1__Norovirus__AJA71472
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgagcugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgacagagacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23035 - RNA, 1623 nt, Artificial Sequence
  derived and/or modified sequence opt4 from VP1__Norovirus__AJA71473
augaagauggccagcagcgacgccagccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgacagagacuucgaggccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23036 - RNA, 1623 nt, Artificial Sequence
  derived and/or modified sequence opt4 from VP1__Norovirus__AJA71474
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgacagagacuucgaggccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacaccgaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23037 - RNA, 1623 nt, Artificial Sequence; identical to SEQ ID NO: 22918
  derived and/or modified sequence opt4 from VP1__Norovirus__AJA71475

SEQ ID NO: 23038 - RNA, 1623 nt, Artificial Sequence; identical to SEQ ID NO: 22997
  derived and/or modified sequence opt4 from VP1__Norovirus__AJA71476

SEQ ID NO: 23039 - RNA, 1623 nt, Artificial Sequence
  derived and/or modified sequence opt4 from VP1__Norovirus__AJF21974
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugagagugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcauccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23040 - RNA, 1623 nt, Artificial Sequence
  derived and/or modified sequence opt4 from VP1__Norovirus__AJF21975
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccaacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23041 - RNA, 1623 nt, Artificial Sequence; identical to SEQ ID NO: 22972
  derived and/or modified sequence opt4 from VP1__Norovirus__AJF21976

SEQ ID NO: 23042 - RNA, 1623 nt, Artificial Sequence
  derived and/or modified sequence opt4 from VP1__Norovirus__AJF21977
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagccacaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccaaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23043 - RNA, 1623 nt, Artificial Sequence
  derived and/or modified sequence opt4 from VP1__Norovirus__AJF21978
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgagaccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacaccgaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23044 - RNA, 1623 nt, Artificial Sequence
  derived and/or modified sequence opt4 from VP1__Norovirus__AJF21979
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagccacaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccaaccacgacuucgaggccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23045 - RNA, 1623 nt, Artificial Sequence
  derived and/or modified sequence opt4 from VP1__Norovirus__AJF21980
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagugguguga

SEQ ID NO: 23046 - RNA, 1623 nt, Artificial Sequence; identical to SEQ ID NO: 23032
  derived and/or modified sequence opt4 from VP1__Norovirus__AJF21981

SEQ ID NO: 23047 - RNA, 1623 nt, Artificial Sequence; identical to SEQ ID NO: 23001
  derived and/or modified sequence opt4 from VP1__Norovirus__AJF21982

SEQ ID NO: 23048 - RNA, 1623 nt, Artificial Sequence
  derived and/or modified sequence opt4 from VP1__Norovirus__AJF21983
augaagauggccagcagcgacgccaaccccagcgacggcagcgccgccagccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgagaccgacaccgacagagacuucgaggccaaccagaacaccaaguucacccccgugggcgugauccaggacggcggcaccacccacagaaacgagccccagcagugggugcugcccagcuacagcggcagaaacgcccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23049 - RNA, 1623 nt, Artificial Sequence
  derived and/or modified sequence opt4 from VP1__Norovirus__AJF21984
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagccacaacuacaccaugaaccuggccagccagaacuggagcaacuacgaccccaccgaggagauccccgccccccugggcacccccgacuucgugggcaagauccagggcgugcugacccagaccaccagagccgacggcagcaccagaggccacaaggccaccguguacaccggcagcgccgacuucgcccccaagcugggcagagugcaguucgagaccgacaccaaccacgacuucgaggccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23050 - RNA, 1623 nt, Artificial Sequence
  derived and/or modified sequence opt4 from VP1__Norovirus__AKE37037
augaagauggccagcaacgacgccgcccccagcaacgacggcgccgccggccuggugcccgagggcaacaacgagacccugccccuggagcccguggccggcgccgccaucgccgcccccgugaccggccagaacaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacagcaaccagcccaacagcagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucagccugcccauccugacccugagcgagcugaccaacagcagauuccccgugcccaucgacagccuguucaccgcccagaacaacgugcugcaggugcagugccagaacggcagaugcacccuggacggcgagcugcagggcaccacccagcugcugcccagcggcaucugcgccuucagaggcagagugaccgcccagaucaaccagagagacagauggcacaugcagcugcagaaccugaacggcaccaccuacgaccccaccgacgacgugcccgccccccugggcacccccgacuucaagggcgugguguucggcauggugagccagagaaacgugggcaacgacgcccccggcagcaccagagcccagcaggccugggugagcaccuacagcccccaguucgugcccaagcugggcagcgugaaccugagaaucagcgacaacgacgacuuccaguuccagcccaccaaguucacccccgugggcgugaacgacgacgacgacggccaccccuucagacagugggagcugcccaacuacagcggcgagcugacccugaacaugaaccuggccccccccguggcccccaacuuccccggcgagcagcugcuguucuucagaagcuucgugcccugcagcggcggcuacaaccagggcaucaucgacugccugaucccccaggaguggauccagcacuucuaccaggagagcgcccccagccagagcgacguggcccugaucagauacgugaaccccgacaccggcagaacccuguucgaggccaagcugcacagaagcggcuacaucaccguggcccacagcggcgacuacccccugguggugcccgccaacggccacuucagauucgacagcugggugaaccaguucuacagccuggcccccaugggcaccggcaacggcagaagaagagcccaguga

SEQ ID NO: 23051 - RNA, 1632 nt, Artificial Sequence
  derived and/or modified sequence opt4 from VP1__Norovirus__AKM20815
augaugauggccagcaaggacgcccccaccaacauggacggcaccagcggcgccggccagcuggugcccgaggccaacaccgccgagccccugcccaucaagcccguggccggcgccgccaccgccguggccaccgccggccaggugaacaugaucgaccccuggaucaugaacaacuucgugcaggccccccagggcgaguucaccaucagccccaacaacacccccggcgacauccuguucgaccugcagcugggcccccaccugaaccccuuccuggcccaccugagcagaauguacaacggcugggugggcaacaugcaggugagaaucaugcuggccggcaacgccuucagcgccggcaagaucaucgugugcugcaucccccccggcuucagcagccagagcaucagcaucgcccaggccaccauguucccccacgugaucgccgacgugagagugcuggagcccaucgacgugccccuggacgacgugagaaacgugcuguuccacaacaacgacaacccccagaccaugagacugcugugcaugcuguacaccccccugagaagcggcggcaccagcagcggcaccgaccccuucgugaucgccggcagagugcugaccugccccacccccgacuucagcuuccuguuccuggugccccccgacaucgagcagagaaccaagcccuucagcgugcccaacauccccaugaaccugaugagcaacagcagagugagcaugcugaucgacggcaugauggugagcaacgaccagaaccaggugccccaguuccagaacggcagagugacccuggacggccagcugcagggcaccaccaccgugagcgccgccugcguggccagaaugagaggcagaaucuucaacaacaacggcaacuacggcgugaaccugaccgagcuggacggcaaccccuaccacgccuucgacagccccgccccccugggcuuccccgacuucggcaacugcgaccugcacaugaccuucgugaagaucaaccccaacgagcugagcagcggcgaccccagcggcaagguggugaucagaagcuacgacgccaccuucgccccccaccugggcaccgugaagcuggagaacgacgacgagcuggccagauucgugggcaaggagguggugcuggagcugaccugggugagcaacagagagggcgccacccugaaccugugggccgugcccaacuacggcagcagccugacccaggccagccagcuggccccccccaucuacccccccggcuucggcgaggccaucguguacuucaccagcaccuuccccaccgugagcaaccccaaggugcccugcacccugccccaggaguucgugagccacuucgugaacgagcaggcccccaccagaggcgacgccgcccugcugcacuacguggaccccgacacccacagaaaccugggcgaguucaagauguaccccgagggcuacaugaccugcgugcccaacgccggcggcggcccccagacccugcccaucaacggcguguucguguucaucagcugggugagcagauacuaccagcugaagcccgugggcaccgccggcgccgccagaagacugggccugagaagaagcuga

SEQ ID NO: 23052 - RNA, 1623 nt, Artificial Sequence
  derived and/or modified sequence opt4 from vp1__Norovirus__AKM20818
augaugauggccagcaaggacgcccccaccagccccgacggcgccagcggcgccggccagcuggugcccgaggccaacaccgccgagcagaucagcauggaccccguggccggcgccagcaccgccguggccaccgccggccaggugaacaugaucgaccccuggaucuucaacaacuucgugcaggccccccagggcgaguucaccaucagccccaacaacacccccggcgacauccuguucgaccugcagcugggcccccaccugaaccccuuccuggcccaccugagccagauguacaacggcugggugggcaacaugagagugagaauccugcuggccggcaacgccuucaccgccggcaagaucaucaucugcugcgugccccccggcuucgacgccagaauccugaccaucgcccaggccacccuguucccccaccugaucgccgacgugagaacccuggagcccguggagcugccccuggaggacgugagaaacgugcuguaccacaacagcagccagccccagcccaccaugagacugguggccaugcuguacaccccccugagaaccggcggcggcagcggcggcaccgacgccuucgugguggccggcagagugcugaccugccccgcccccgacuucagcuuccuguuccuggugccccccagcguggagcagaagaccagaguguucagcgugcccaacaucccccugaaggaccugagcaacagcagagugcccgugcccauccagggcauguucaugagccccgacgugaaccagagcgugcaguuccagaacggcagaugccagaucgacggccagcugcagggcaccacccccgugagccugagccagcugugcaagaucagaggcaagaccagcagcaacgccagagugcugaaccugagcgagguggacggcacccccuucaucccccuggagagccccgcccccgugggcuuccccgaccugggcggcugcgacuggcacgugaacuucagcuuccagacccaggacagagaccccagccagagcgugaccuucgccaccaacgacgccagcuucgugcccuaccugggcagcgugagcccccacaacggcgagggcuuccaggccggcgacaucaucggcagccugggcuggaucagcgcccccagcgacaacagccaguucaacgugugggccauccccaaguacggcagcagccugcccgacgugacccaccuggcccccgccguguucccccccggcuucggcgaggugauccuguacuucuacagcaccuuccccggcagcggccagcccagccagcugcaggugcccugccugcugccccaggaguucaucacccacuucugcaacgagcaggcccccaucgccggcgaggccgcccugcugcacuacguggaccccgacaccggcagaaaccugggcgaguucaagcuguaccccgacggcuucaugaccugcgugcccaacagcgugagcagcggcccccagacccugcccaucaacggcguguucguguucgugagcugggugagcagauucuaccagcugaagcccgugggcaccgccagcgccgccagaagacugggccugagaagaaucuga

SEQ ID NO: 23053 - RNA, 1623 nt, Artificial Sequence
  derived and/or modified sequence opt4 from VP1__Norovirus__ALD83748
augaagauggccagcaacgacgccgcccccagcaacgacggcgccaccggccuggugcccgaggugaacaacgagacccugccccuggagcccguggccggcgccgccaucgccgcccccgugaccggccagaacaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacaacaaccagcccaccaacagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucagccugcccauccugaccaucagcgagcugaccaacagcagauuccccgugcccguggacagccuguucaccgcccagaacaacaaccugaacgugcagugccagaacggcagaugcacccuggacggcgagcugcagggcaccacccagcugcagcccagcggcaucugcgccuucagaggcaagaucaccgccgacgugagacccaaccacgacgacagauggcacaugcagcugaccaaccugaacggcacccccuucgaccccaccgaggacgugcccgccccccugggcacccccgacuucaccggccugcuguucggcguggccagccagagaaacgugcagcccaaccccaacaccaccagagcccacgaggccgugaucagcaccaccagcagccaguucgugcccaagcugggcagcaucaacuucggcagcaccagcgaggacuucaucgugggccagcccaccaaguucacccccgugggcaucaagaucgaggacggccacgccuucgaccaguggacccugcccagauacagcggccaccugacccugaacaugaaccuggccccccccguggcccccaacuuccccggcgagcagcugcuguucuucagaagcaacgugcccugcgccggcggcaucagcgacggcgugaucgacugccugcugccccaggaguggauccagcacuucuaccaggagagcgcccccagccagagcgacguggcccugaucagauacgugaaccccgacaccggcagaacccuguucgaggccaagcugcacagaaccggcuacaucaccguggcccacagcggcgacuacccccugguggugcccagcaacggcuacuucagauucgacagcugggugaaccaguucuacagccuggcccccaugggcaccggcaacggcagaagaagagugcaguga

SEQ ID NO: 23054 - RNA, 1623 nt, Artificial Sequence
  derived and/or modified sequence opt4 from VP1__Norovirus__ALF12528
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcaccuucguggugcagccccagaacggcagaugcaccaccgacggcgugcugcugggcaccacccagcugagccccgugaacaucugcaccuucagaggcgacgugacccacaucgccggcagccacaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacagcagccccaagcugggcagagugcaguucgccaccgacaccgacaacgacuucguggccaaccagaacaccaaguucacccccgugggcgugauccaggacggcggcaccgcccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugacccaggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23055 - RNA, 1623 nt, Artificial Sequence
  derived and/or modified sequence opt4 from VP1__Norovirus__ALF12529
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucguguucagcgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcaccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgacgccaaccagaacaccaaguucacccccgugggcgugauccaggacggcaacaccgcccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccacuucuacacccuggcccccgugggcaacggcaccggcagaagaagagcccuguga

SEQ ID NO: 23056 - RNA, 1623 nt, Artificial Sequence
  derived and/or modified sequence opt4 from VP1__Norovirus__ALF12530
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagccacaacuacaccaugaaccuggccagccagaacuggaacagcuacgaccccaccgaggagauccccgccccccugggcacccccgacuucgugggcaagauccagggcgugcugacccagaccaccagagccgacggcagcaccagaggccacaaggccaccguguacaccggcagcgccgacuucagccccaagcugggcagagugcaguucgccaccgacaccaacaacgacuucgacgccaaccagaacaccaaguucacccccgugggcgugauccaggacggcgagaccgcccacagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggagcuggacugccugaucccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23057 - RNA, 1623 nt, Artificial Sequence
  derived and/or modified sequence opt4 from VP1__Norovirus__ALF12531
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccagaacuggaacagcuacgaccccaccgaggagauccccgccccccuggagacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgacagcaaccagaacaccaaguucacccccgugggcgugauccaggacggcggcaccacccacagaaacgagccccagcagugggugcugcccagcuacagcggcagagacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagugcuguga

SEQ ID NO: 23058 - RNA, 1623 nt, Artificial Sequence
  derived and/or modified sequence opt4 from VP1__Norovirus__ALF12532
augaagauggccagcagcgacgccaaccccagcgacggcagcaccgccaaccuggugcccgaggugaacaacgaggugauggcccuggagcccguggugggcgccgccaucgccgcccccguggccggccagcagaacgccaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgacgccaaccagaacaccaaguucacccccgugggcgugauccaggacggcggcaccacccacagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23059 - RNA, 1623 nt, Artificial Sequence
  derived and/or modified sequence opt4 from VP1__Norovirus__ALF12533
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaccuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcaccuucguggugcagccccagaacggcagaugcaccaccgacggcgugcugcugggcaccacccagcugagccccgugaacaucugcaccuucagaggcgacgugacccacaucaccggcagccacaacuacaccaugaaccuggccagccagaacuggagcagcuacgaccccaccgaggagauccccgccccccugggcacccccgacuucgugggcaagauccagggcgugcugacccagaccaccagaaccgacggcagcaccagaggccacaaggccaccguguucaccggcagcgccgacuucagccccaagcugggcagagugcaguucgccaccgacaccgacaacgacuucguggccaaccagaacaccaaguucacccccgugggcgugauccaggacggcggcaccgcccacagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23060 - RNA, 1623 nt, Artificial Sequence
  derived and/or modified sequence opt4 from VP1__Norovirus__ALF12534
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuucagccuggcccccaugggcaacggcaccggcagaagaagagcccuguga

SEQ ID NO: 23061 - RNA, 1623 nt, Artificial Sequence
  derived and/or modified sequence opt4 from VP1__Norovirus__ALF12535
augaagauggccagcagcgacgccaaccccagcgugggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcuggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaccaccggcagccacaacuacaccaugaaccuggccacccagaacuggaacagcuacgaccccaccgaggagauccccgccccccugggcacccccgacuucgugggcaagauccagggcgugcugacccagaccaccaagaccgacggcagcaccagaggccacaaggccaccguguacaccggcagcgccgacuucgcccccaagcugggcagagugcaguucgccaccgacaccgacaacgacuucgaggccaaccagaacaccaaguucacccccgugggcgugauccaggacggcggcaccgcccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcaccggcagaagaagagcccuguga

SEQ ID NO: 23062 - RNA, 1623 nt, Artificial Sequence
  derived and/or modified sequence opt4 from VP1__Norovirus__ALF12536
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaccaccggcagccacaacuacaccaugaaccuggccacccagaacuggagcagcuacgaccccaccgaggagauccccgccccccugggcacccccgacuucgugggcaagauccagggcgugcugacccagaccaccaagaccgacggcagcaccagaggccacaaggccaccguguacaccggcagcgccgacuucgcccccaagcugggcagagugcaguucgccaccgacaccgacaacgacuucgaggccaaccagaacaccaaguucacccccgugggcgugauccaggacggcaacaccgcccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcaccggcagaagaagagcccuguga

SEQ ID NO: 23063 - RNA, 1623 nt, Artificial Sequence
  derived and/or modified sequence opt4 from VP1__Norovirus__ALF12537
augaagauggccagcagcgacgccaaccccagcgacggcagcaccgccaaccuggcccccgaggugaacaacgaggugauggcccuggagcccguggugggcgccgccaucgccgcccccguggccggccagaagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgcccccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagagagaccuggugaucccccccaacggcuacuucagauucgacagcugggugaaccaguucuacagccuggcccccaugggcaacggcaccggcagaagaagagcccuguga

SEQ ID NO: 23064 - RNA, 1623 nt, Artificial Sequence
  derived and/or modified sequence opt4 from VP1__Norovirus__ALF12538
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucagcgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcagcaccgacggcgugcugcugggcaccacccagcugagccccgugaacaucugcaccuucagaggcgacgugacccacaucgccggcagccacaacuacaccaugaaccuggccagccagaacuggagcagcuacgaccccaccgaggagauccccgccccccugggcacccccgacuucgugggcaagauccagggcgugcugacccagaccaccagaagcgacggcagcaccagaggccacaaggccaccguguacaccggcagcgccgacuucagccccaagcugggcagagugcaguucgccaccgacaccgacaacgacuucgugagcaaccagaacaccaaguucacccccgugggcgugauccaggacggcgacaccgcccacagaaacgagccccagcagugggugcugcccagcuacagcggcagaaacauccacaacgugcaccuggcccccgccguggcccccaccuuccccggcgagcagcugcuguucuucagaagcaccauccccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccacuucuacacccuggcccccaugggcaacggcaccggcagaagaagagugcuguga

SEQ ID NO: 23065 - RNA, 1623 nt, Artificial Sequence
  derived and/or modified sequence opt4 from VP1__Norovirus__ALF12539
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguuccccagaaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcagcaccgacggcgugcugcugggcaccacccagcugagccccgugaacaucugcaccuucagaggcgacgugacccacaucgccggcagccacaacuacaccaugaaccuggccagccagaacuggagcagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccaacaacgacuucgagagcaaccagaacaccaaguucgcccccgugggcgugauccaggacggcggcaccgcccacagaaacgagccccagcagugggugcugcccagcuacagcggcagaaacauccacaacgugcaccuggcccccgccguggcccccaccuuccccggcgagcagcugcuguucuucagaagcaccauccccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23066 - RNA, 1623 nt, Artificial Sequence
  derived and/or modified sequence opt4 from VP1__Norovirus__ALF12541
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggugggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcagcgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagccacaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcaccgacuucacccccaagcugggcagagcccaguucgccaccgacaccgacaacgacuucgagaccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23067 - RNA, 1623 nt, Artificial Sequence
  derived and/or modified sequence opt4 from VP1__Norovirus__ALF12542
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcgcccccgacuucgugggcaagauccagggcaugcugacccagaccaccagagccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagagcccuguga

SEQ ID NO: 23068 - RNA, 1623 nt, Artificial Sequence
  derived and/or modified sequence opt4 from VP1__Norovirus__ALF12543
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacugcgaccccaccgaggagauccccgccccccugggcacccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23069 - RNA, 1623 nt, Artificial Sequence
  derived and/or modified sequence opt4 from VP1__Norovirus__ALF12546
augaagauggccagcagcgacgccaaccccagcgagggcagcaccgccagccuggugcccgaggugaacaacgaggugauggcccuggagcccguggccggcgccgccaucgccgcccccguggccggccaggugaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgagcccaccaucaagcugguggccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcagcuucguggugcagccccagaacggcagaugcaccaccgacggcgugcugcugggcaccacccagcugagccccgugaacaucugcaccuucagaggcgacgugacccacaucagcggcagcagaaaccacaccaugaaccuggccagccagaacuggaacagcuacgaccccaccgaggagauccccgccccccugggcacccccgacuucgugggcaagauccagggcgugcugacccagaccaccagaagcgacggcagcaccagaggccacaaggccaccguguacaccggcagcgccgacuucagccccaagcugggcagaauccaguucgccaccgacaccgacaacgacuucgagaccaaccagaacaccaaguucacccccgugggcgugauccaggacggcggcaccacccacagaaacgagccccagcagugggugcugcccaccuacagcggcagaaacacccacaacgugcaccuggcccccgccguggcccccaccuuccccggcgagcagcugcuguucuucagaagcaccaugcccggcugcagcggcuaccccgacauggaccuggacugccugcugccccaggagugggugcagcacuucuaccaggaggccgcccccgcccagagcgacguggcccugcugagauucgugaaccccgacaccggcagagugcuguucgagugcaagcugcacaaggccggcuacgugaccguggcccacaccggccagcacgaccuggugaucccccccaacggcuacuucagauucgacagcugggugaaccaguucuucacccuggcccccaugggcaacggcaccggcagaagaagagcccuguga

SEQ ID NO: 23070 - RNA, 1623 nt, Artificial Sequence
  derived and/or modified sequence opt4 from VP1__Norovirus__ALF12547
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaagcgcccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23071 - RNA, 1623 nt, Artificial Sequence
  derived and/or modified sequence opt4 from VP1__Norovirus__ALF12560
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaagcaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacagcgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcagcuucagaggcgacgugacccacaucgccggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacagagccaccguguacaccggcagcgccgacuucagccccaagcugggcagagugcaguucgccaccgacaccgacaacgacuucguggccaaccagaacaccaaguucacccccgugggcgugauccaggacggcgacaccgcccacagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23072 - RNA, 1623 nt, Artificial Sequence
  derived and/or modified sequence opt4 from VP1__Norovirus__ALF12562
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcaccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23073 - RNA, 1623 nt, Artificial Sequence
  derived and/or modified sequence opt4 from VP1__Norovirus__ALF12564
augaagauggccagcagcgacgccaacagcagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccacccagaacuggaacagcuacgaccccaccgaggagauccccgccccccugggcacccccgacuucgugggcaagauccagggcgugcugacccagaccaccaagaccgacggcagcaccagaggccacaaggccaccguguacaccggcagcgccgacuucgcccccaagcugggcagagugcaguucgccaccgacaccgacaacgacuucgaggccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcaccggcagaagaagagccaccuga

SEQ ID NO: 23074 - RNA, 1623 nt, Artificial Sequence
  derived and/or modified sequence opt4 from VP1__Norovirus__ALF12566
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagagacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaugaucguggacgugagacagcuggagcccgugcugaucccccugcccgacgugagaaacaacuucuaccacuacaaccagagcaacgaccccacccugaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcgcccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagaaucguguga

SEQ ID NO: 23075 - RNA, 1623 nt, Artificial Sequence
  derived and/or modified sequence opt4 from VP1__Norovirus__ALF12569
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcccuucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccuacggcuacuucagauucgacagcugggugaaccaguucuacacccuggcccccaugggcaacggcaccggcagaagaagagcccuguga

SEQ ID NO: 23076 - RNA, 1623 nt, Artificial Sequence; identical to SEQ ID NO: 23050
  derived and/or modified sequence opt4 from VP1__Norovirus__ALQ28762

SEQ ID NO: 23077 - RNA, 1632 nt, Artificial Sequence
  derived and/or modified sequence opt4 from VP1__Norovirus__ALS03883
augaagauggccagcaacgacgccgcccccagcaacgacggcgccgccggccuggugcccgagaucaacaacgagaccauggcccuggagcccguggccggcggcgccaucgccgccccccugaccggccagaccaacuucaucgaccccuggaucagaggcaacuacgugcaggcccccaacggcgaguucaccgugagccccagaaacagccccggcgagauccugcugaaccuggagcugggccccgagcugaaccccuuccugagccaccugagcagaauguacaacggcuacgccggcggcaucgacgugcaggugaucauggccggcaacgccuucaccgccggcaagaucaucuucgccgccauccccccccacuuccccguggagaaccugagccccccccagaucaccauguucccccacaucaucguggacgugagaacccuggagcccaucaacauccccgugcccgacgugagaaacaacuucuuccacuacaaccagaacaacgagagcagaaugagacugguggccaugcuguacaccccccugagaagcaacggcagcgccgaggacguguucaccgugagcugcagagugcugaccaagcccagcgccgacuucgaguucaacuaccuggugccccccaccguggagagcagaaccaagcccuucaccauccccauccugaccaucggcgagaugaccaacagcagauuccccgugcccaucgacaugcugcacaccagccccaccgagaacaucguggugcagccccagaacggcagaugcaccaucgacggcgagcugcugggcaccacccagcugaucaccagcaacaucugcagcuucagaggcagcaucagcggccacgagggcaacgacgaccagcaccuguggcacuucaacaucaccaaccccaacggcacccccuucgaccccaccgaggacgugcccgccccccugggcacccccgacuucagaggccagcuguacggcgugaucagccagagagacagagagggcacccccagcgagaacaaccagaaggccaacagaagccaccagggcgugaucagcaccaucagccccaaguucgugcccaagcugggcagcgugaugaucggcaccuggaccaccgacgacaucaagaaccagcccagcaaguucacccccaucggccugaacgacgacgacaacuucaagcagugggagcugcccaacuacagcggcgcccugacccugaacaugggccuggcccccagcguguuccccaccuaccccggcgagcagauccuguucuucagaagcuaccugccccugaagggcggcuacggcagccccuucaucgacugccuggugccccaggaguggguggcccacuucuaccaggagagcgcccccgcccagaccgacguggcccugaucagauacgugaaccccgagaccggcagagugcuguucgaggccaagcugcacagacagggcuucaucaccguggccaagagcggcgacagccccaucaacgugcccgccaacggcuacuucagauucgacagcugggugaaccaguucuacagccuggcccccaugggcaccggcaacggcagaagaagaauccaguga

SEQ ID NO: 23078 - RNA, 1617 nt, Artificial Sequence
  derived and/or modified sequence opt4 from VP1__Norovirus__ALT06546
augaagauggccagcaacgacgccgcccccagcaacgacggcgccgccggccuggugcccgagggcaacaacgagacccugccccuggagcccguggccggcgccgccaucgccgcccccgugaccggccagaacaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacaacaaccagcccaacagcagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucagccugcccauccugacccugagcgagcugaccaacagcagauuccccgugcccaucgacagccuguucaccgcccagaacaacgugcugcaggugcagugccagaacggcagaugcacccuggacggcgagcugcagggcaccacccagcugcugcccagcggcaucugcgccuucagaggcagagugaccgccgagaccgaccacagagacaaguggcacaugcagcugcagaaccugaacggcaccaccuacgaccccaccgacgacgugcccgccccccugggcacccccgacuucaagggcgugguguucggcauggccagccagagaaacgugggcaacgacgcccccggcagcaccagagcccacgaggccgugaucagcaccuacagcccccaguucgugcccaagcugggcagcgugaacuucagaagcaacgacaacgacuuccagcugcagcccaccaaguucacccccgugggcaucaacgacgacggcgaccaccccuucagacagugggagcugcccgacuacagcggcccccugacccugaacaugaaccuggccccccccguggcccccaacuuccccggcgagcagcugcuguucuucagaagcuucgugcccugcagcggcggcuacaaccagggcaucguggacugccugaucccccaggaguggauccagcacuucuaccaggagagcgcccccagccagagcgacguggcccugaucagauacgugaaccccgacaccggcagaacccuguucgaggccaagcugcacagaagcggcuacaucaccguggcccacagcggcgacuacccccugguggugcccgccaacggcuacuucagauucgacagcugggugaaccaguucuacagccuggcccccaugggcaccggcaacggcagaagaagagcccaguga

SEQ ID NO: 23079 - RNA, 1647 nt, Artificial Sequence
  derived and/or modified sequence opt4 from VP1__Norovirus__BAG30939
augaagauggccagcaacgacgccacccccagcaacgacggcgccgccggccuggugcccgagaucaacaacgaggccauggcccuggaccccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgccuucaccgccggcaagaucaucuucgccgccaucccccccaacuuccccaucgacaaccugagcgccagacagaucaccaugugcccccacgugaucguggacgugagacagcuggagcccgugaaccugcccaugcccgacgugagaaacaacuucuuccacuacaaccagggcagcgacagcagacugagacugaucgccaugcuguacaccccccugagagccaacaacagcggcgacgacguguucaccgugagcugcagagugcugaccagacccagccccgacuucagcuucaacuuccuggugccccccaccguggagagcaagaccaagcccuucacccugcccauccugaccaucagcgagaugagcaacagcagauuccccgugcccaucgacagccugcacaccagccccaccgagaacaucguggugcagugccagaacggcagagugacccuggacggcgagcugaugggcaccacccagcugcugcccagccagaucugcgccuucaugggcgugcugaccagaagcaccagcagagccagcgaccaggccgacaccgccacccccagacuguucaacuacuacuggcacauccagcuggacaaccccaacggcacccccuacgaccccgccgaggacauccccggcccccugggcacccccgacuucagaggcaagguguucggcguggccagccagagaaaccccgacagcaccaccagagcccacgaggccaagguggacaccaccgccggcagauucacccccaagcugggcagccuggagaucagcaccgagagcgacgacuuccaccagaaccagcccaccagauucacccccgugggcaucggcguggacaacgaggccgacuuccagcaguggagccugcccgacuacagcggccaguucacccacaacaugaaccuggcccccgccguggcccccaacuuccccggcgagcagcugcuguucuucagaagccagcugcccagcagcggcggcagaagcaacggcauccuggacugccuggugccccaggagugggugcagcacuucuaccaggagagcgcccccagccagacccagguggcccuggugagauacgugaaccccgacaccggcagagugcuguucgaggccaagcugcacaagcugggcuucaugaccaucgccaagaacggcgacagccccaucaccgugccccccaacggcuacuucagauucgagagcugggugaaccccuucuacacccuggcccccaugggcaccggcaacggcagaagaagaauccaguga

SEQ ID NO: 23080 - RNA, 1623 nt, Artificial Sequence; identical to SEQ ID NO: 22522
  derived and/or modified sequence opt4 from VP1__Norovirus__BAG70428

SEQ ID NO: 23081 - RNA, 1623 nt, Artificial Sequence; identical to SEQ ID NO: 22522
  derived and/or modified sequence opt4 from VP1__Norovirus__BAG70431

SEQ ID NO: 23082 - RNA, 1623 nt, Artificial Sequence
  derived and/or modified sequence opt4 from VP1__Norovirus__BAG70434
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgcccacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23083 - RNA, 1623 nt, Artificial Sequence
  derived and/or modified sequence opt4 from VP1__Norovirus__BAG70437
augaagauggccagcaacgacgccaaccccagcgacggcagcaccgccaaccuggugcccgaggugaacaacgaggugauggcccuggagcccguggugggcgccgccaucgccgcccccguggccggccagaccaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccaaggugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23084 - RNA, 1623 nt, Artificial Sequence
  derived and/or modified sequence opt4 from VP1__Norovirus__BAG70440
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggccuacaccggccagcacgaccuggugaucccccccaacggcuacuucagauucgacagcugggugaaccaguucuacacccuggcccccaugggcaacggcaccggcagaagaagagcccuguga

SEQ ID NO: 23085 - RNA, 1623 nt, Artificial Sequence
  derived and/or modified sequence opt4 from VP1__Norovirus__BAG70446
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacagcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccaggaguacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcgugcacuucacccccaagcugggcagaauccaguucagcaccgacaccagcaacgacuucgagaccggccagaacaccagauucacccccgugggcguggugcaggacggcagcaccacccaccagaacgagccccagcagugggugcugcccaacuacagcggcagagacagccacaacgugcaccuggcccccgccguggcccccagcuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23086 - RNA, 1623 nt, Artificial Sequence
  derived and/or modified sequence opt4 from VP1__Norovirus__BAG70449
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacagcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23087 - RNA, 1623 nt, Artificial Sequence
  derived and/or modified sequence opt4 from VP1__Norovirus__BAG70452
augaagauggccagcaacgacgccaaccccagcgacggcagcgccgccaaccuggugcccgaggugaacaacgaggugauggcccuggagcccguggugggcgccgccaucgccgcccccguggccggccagaccaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagcugaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23088 - RNA, 1623 nt, Artificial Sequence; identical to SEQ ID NO: 22392
  derived and/or modified sequence opt4 from VP1__Norovirus__BAG70458

SEQ ID NO: 23089 - RNA, 1623 nt, Artificial Sequence; identical to SEQ ID NO: 22070
  derived and/or modified sequence opt4 from VP1__Norovirus__BAG70461

SEQ ID NO: 23090 - RNA, 1623 nt, Artificial Sequence; identical to SEQ ID NO: 22070
  derived and/or modified sequence opt4 from VP1__Norovirus__BAG70464

SEQ ID NO: 23091 - RNA, 1623 nt, Artificial Sequence; identical to SEQ ID NO: 22070
  derived and/or modified sequence opt4 from VP1__Norovirus__BAG70467

SEQ ID NO: 23092 - RNA, 1623 nt, Artificial Sequence; identical to SEQ ID NO: 22522
  derived and/or modified sequence opt4 from VP1__Norovirus__BAG70470

SEQ ID NO: 23093 - RNA, 1623 nt, Artificial Sequence; identical to SEQ ID NO: 22522
  derived and/or modified sequence opt4 from VP1__Norovirus__BAG70473

SEQ ID NO: 23094 - RNA, 1623 nt, Artificial Sequence
  derived and/or modified sequence opt4 from VP1__Norovirus__BAG70476
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagcugcccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23095 - RNA, 1623 nt, Artificial Sequence
  derived and/or modified sequence opt4 from VP1__Norovirus__BAG70482
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgacggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23096 - RNA, 1623 nt, Artificial Sequence; identical to SEQ ID NO: 22070
  derived and/or modified sequence opt4 from VP1__Norovirus__BAG70485

SEQ ID NO: 23097 - RNA, 1623 nt, Artificial Sequence; identical to SEQ ID NO: 22070
  derived and/or modified sequence opt4 from VP1__Norovirus__BAG70488

SEQ ID NO: 23098 - RNA, 1623 nt, Artificial Sequence
  derived and/or modified sequence opt4 from VP1__Norovirus__BAG70491
augaagauggccagcaacgacgccagccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcaccagaaccuacagaaugaaccuggccagccagaacuggaacaacuacgaccccaccgaggagauccccgccccccugggcacccccgacuucgugggcaagauccagggcaugcugacccagaccaccaagggcgacggcagcaccagaggccacaaggccaccgugagcaccggcagcguggacuucacccccaagcugggcagcgugcaguucgccaccgacaccgacaacgacuucgagaccggccagaacaccagauucacccccgugggcgugauccaggacggcagcagcacccacagaaacgagccccagcagugggugcugcccgacuacagcggcagaaccgcccacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccagccagagcgacguggcccugcugagauucgugaaccccgacaccggcagagugcuguucgagugcaagcugcacaaggccggcuacgugaccguggcccacaccggccagcacgaccuggugaucccccccaacggcuacuucagauucgacagcugggugaaccaguucuacacccuggcccccaugggcaacggcgccggcagaagaagagcccuguga

SEQ ID NO: 23099 - RNA, 1623 nt, Artificial Sequence
  derived and/or modified sequence opt4 from VP1__Norovirus__BAG70494
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagagacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccacuucuacacccuggcccccaugggcaacggcaccggcagaagaagagcccuguga

SEQ ID NO: 23100 - RNA, 1623 nt, Artificial Sequence; identical to SEQ ID NO: 22392
  derived and/or modified sequence opt4 from VP1__Norovirus__BAG70497

SEQ ID NO: 23101 - RNA, 1623 nt, Artificial Sequence; identical to SEQ ID NO: 22562
  derived and/or modified sequence opt4 from VP1__Norovirus__BAG70503

SEQ ID NO: 23102 - RNA, 1623 nt, Artificial Sequence; identical to SEQ ID NO: 22392
  derived and/or modified sequence opt4 from VP1__Norovirus__BAG70506

SEQ ID NO: 23103 - RNA, 1623 nt, Artificial Sequence
  derived and/or modified sequence opt4 from VP1__Norovirus__BAG70509
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcaccagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23104 - RNA, 1623 nt, Artificial Sequence
  derived and/or modified sequence opt4 from VP1__Norovirus__BAG70512
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcaccagaaacuacaccaugaaccuggccagccugagcuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugaugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23105 - RNA, 1623 nt, Artificial Sequence
  derived and/or modified sequence opt4 from VP1__Norovirus__BAG70515
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggccugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23106 - RNA, 1623 nt, Artificial Sequence; identical to SEQ ID NO: 23105
  derived and/or modified sequence opt4 from VP1__Norovirus__BAG70518

SEQ ID NO: 23107 - RNA, 1623 nt, Artificial Sequence
  derived and/or modified sequence opt4 from VP1__Norovirus__BAG70521
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacagcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccaggaguacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcgugcacuucacccccaagcugggcagaauccaguucagcaccgacaccagcaacgacuucgagaccggccagaacaccagauucacccccgugggcguggugcaggacggcggcaccacccaccagaacgagccccagcagugggugcugcccaacuacagcggcagagacagccacaacgugcaccuggcccccgccguggcccccagcuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23108 - RNA, 1623 nt, Artificial Sequence
  derived and/or modified sequence opt4 from VP1__Norovirus__BAG70524
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggccugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugaucuucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23109 - RNA, 1623 nt, Artificial Sequence
  derived and/or modified sequence opt4 from VP1__Norovirus__BAG70527
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacagcuacgaccccaccgaggagauccccgccccccugggcacccccgacuucgugggcaagauccagggccugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23110 - RNA, 1623 nt, Artificial Sequence; identical to SEQ ID NO: 23105
  derived and/or modified sequence opt4 from VP1__Norovirus__BAG70530

SEQ ID NO: 23111 - RNA, 1623 nt, Artificial Sequence; identical to SEQ ID NO: 23105
  derived and/or modified sequence opt4 from VP1__Norovirus__BAG70533

SEQ ID NO: 23112 - RNA, 1623 nt, Artificial Sequence; identical to SEQ ID NO: 23105
  derived and/or modified sequence opt4 from VP1__Norovirus__BAG70536

SEQ ID NO: 23113 - RNA, 1623 nt, Artificial Sequence; identical to SEQ ID NO: 22671
  derived and/or modified sequence opt4 from VP1__Norovirus__BAI70518

SEQ ID NO: 23114 - RNA, 1623 nt, Artificial Sequence
  derived and/or modified sequence opt4 from VP1__Norovirus__BAJ13508
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagagacuguacaccggccccagcagcgccuucguggugcagccccagaacggcagaugcaccaccgacggcgugcugcugggcaccacccagcugagcgccgugaacaucugcaccuucagaggcgacgugacccacaucgccggcagcagaaacuacaccaugaaccuggccagccagaacuggaacaacuacgaccccaccgaggagauccccgccccccugggcacccccgacuucgugggcaagauccagggcaugcugacccagaccaccagaagcgacggcagcaccagaggccacaaggccaccgugcugaccggcagcgccgacuucgcccccaagcugggcagagugcaguucgccaccgacaccgacaacgacuucgagagcggccagaacaccaaguucacccccgugggcgugauccaggacggcagcaccacccacagaaacgagccccagcagugggugcugcccaacuacagcggcagaaccggccacaacgugcaccuggcccccgccguggcccccaccuaccccggcgagcagcugcuguucuucagaagcaccaugcccggcugcagcggcuaccccaacauggaccuggacugccugcugccccaggagugggugcagcacuucuaccaggaggccgcccccgcccagagcgacauggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagccguguga

SEQ ID NO: 23115 - RNA, 1623 nt, Artificial Sequence
  derived and/or modified sequence opt4 from VP1__Norovirus__BAJ13513
augaagauggccagcagcgacgccaacccccccgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgccacccacaucgccggcagcagaagcuacaccaugaaccuggccagccugaacuggaacaacuacgaccccaccgaggagauccccgccccccugggcacccccgacuucgugggcaagauccagggcaugcugacccagaccaccaagggcgacggcagcaccagaggccacaaggccaccguguacaccggcagcgcccccuucacccccaagcugggcagcgugcaguucagcaccgacaccgagaacgacuuccagacccaccagaacaccaaguucacccccgugggcgugauccaggacggcagcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23116 - RNA, 1623 nt, Artificial Sequence
  derived and/or modified sequence opt4 from VP1__Norovirus__BAJ13520
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcaugcugacccagaccaccaagggcgacggcagcaccagaggccacaaggccaccguguacaccggcagcgcccccuucacccccaagcugggcaacgugcaguucagcaccgacaccgagaacgacuucgagacccaccagaacaccaaguucacccccgugggcgugauccaggacggcagcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23117 - RNA, 1623 nt, Artificial Sequence
  derived and/or modified sequence opt4 from VP1__Norovirus__BAJ13534
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcagcgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23118 - RNA, 1623 nt, Artificial Sequence
  derived and/or modified sequence opt4 from VP1__Norovirus__BAJ13537
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcagguggugcuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccacccagaacuggaacagcuacgaccccaccgaggagauccccgccccccugggcacccccgacuucgugggcaagauccagggcgugcugacccagaccaccagagccgacggcagcaccagaggccacaaggccaccguguacaccggcagcgccgacuucgcccccaagcugggcagagugcaguucgccaccgacaccgacaacgacuucgacgccaaccagaacaccaaguucacccccgugggcgugauccaggacggcgacaccgcccacagaaacgagccccagcagugggugcugcccagcuacagcggcagaaacaaccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23119 - RNA, 1623 nt, Artificial Sequence
  derived and/or modified sequence opt4 from VP1__Norovirus__BAJ13540
augaagauggccagcaacgacgccaaccccagcgacggcagcgccgccaaccuggugcccgaggugaacaacgaggugauggcccuggagcccguggugggcgccgccaucgccgcccccguggccggccagaccaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgugggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgaggcccaccagaacaccaaguucacccccgugggcgugauccaggacggcagcaccacccacagaaacgagccccagcagugggugcugcccagcuacagcggcagaaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23120 - RNA, 1623 nt, Artificial Sequence; identical to SEQ ID NO: 23082
  derived and/or modified sequence opt4 from VP1__Norovirus__BAJ13543

SEQ ID NO: 23121 - RNA, 1623 nt, Artificial Sequence; identical to SEQ ID NO: 23082
  derived and/or modified sequence opt4 from VP1__Norovirus__BAJ13549

SEQ ID NO: 23122 - RNA, 1623 nt, Artificial Sequence
  derived and/or modified sequence opt4 from VP1__Norovirus__BAJ13552
augaagauggccagcaacgacgccaaccccagcgacggcagcgccgccaaccuggugcccgaggugaacaacgaggugauggcccuggagcccguggugggcgccgccaucgccgcccccguggccggccagaccaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgaggcccaccagaacaccaaguucacccccgugggcgugauccaggacggcagcaccacccacagaaacgagccccagcagugggugcugcccagcuacagcggcagaaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23123 - RNA, 1623 nt, Artificial Sequence
  derived and/or modified sequence opt4 from VP1__Norovirus__BAJ13555
augaagauggccagcaacgaccccagccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagagacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23124 - RNA, 1623 nt, Artificial Sequence; identical to SEQ ID NO: 23122
  derived and/or modified sequence opt4 from VP1__Norovirus__BAJ13558

SEQ ID NO: 23125 - RNA, 1623 nt, Artificial Sequence; identical to SEQ ID NO: 22392
  derived and/or modified sequence opt4 from VP1__Norovirus__BAJ13561

SEQ ID NO: 23126 - RNA, 1623 nt, Artificial Sequence
  derived and/or modified sequence opt4 from VP1__Norovirus__BAJ13564
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaucaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23127 - RNA, 1623 nt, Artificial Sequence
  derived and/or modified sequence opt4 from VP1__Norovirus__BAJ13567
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagagacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugagauucagcaccgacaccgagaacgacuucgagacccaccagaacaccaaguucacccccgugggcgugauccaggacggcagcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagcccggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23128 - RNA, 1623 nt, Artificial Sequence; identical to SEQ ID NO: 23122
  derived and/or modified sequence opt4 from VP1__Norovirus__BAJ13573

SEQ ID NO: 23129 - RNA, 1623 nt, Artificial Sequence
  derived and/or modified sequence opt4 from VP1__Norovirus__BAJ13576
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccccuggagcgagccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgccgacuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23130 - RNA, 1623 nt, Artificial Sequence
  derived and/or modified sequence opt4 from VP1__Norovirus__BAJ13579
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgccgacuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23131 - RNA, 1623 nt, Artificial Sequence; identical to SEQ ID NO: 22522
  derived and/or modified sequence opt4 from VP1__Norovirus__BAJ13582

SEQ ID NO: 23132 - RNA, 1623 nt, Artificial Sequence; identical to SEQ ID NO: 22671
  derived and/or modified sequence opt4 from VP1__Norovirus__BAJ13585

SEQ ID NO: 23133 - RNA, 1623 nt, Artificial Sequence
  derived and/or modified sequence opt4 from VP1__Norovirus__BAJ13591
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcuguacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23134 - RNA, 1623 nt, Artificial Sequence
  derived and/or modified sequence opt4 from VP1__Norovirus__BAJ13594
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcaugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23135 - RNA, 1623 nt, Artificial Sequence; identical to SEQ ID NO: 23122
  derived and/or modified sequence opt4 from VP1__Norovirus__BAJ13597

SEQ ID NO: 23136 - RNA, 1623 nt, Artificial Sequence
  derived and/or modified sequence opt4 from VP1__Norovirus__BAJ13603
augaagauggccagcaacgacgccaaccccagcgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23137 - RNA, 1623 nt, Artificial Sequence
  derived and/or modified sequence opt4 from VP1__Norovirus__BAJ13606
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagagacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccggcgacgacuuccagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaaggccggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23138 - RNA, 1623 nt, Artificial Sequence
  derived and/or modified sequence opt4 from VP1__Norovirus__BAJ13609
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaucaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccugacccccaugggcaacggcaccggcagaagaagagcccuguga

SEQ ID NO: 23139 - RNA, 1623 nt, Artificial Sequence
  derived and/or modified sequence opt4 from VP1__Norovirus__BAJ13612
augaagauggccagcaacgacgccaaccccagcgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23140 - RNA, 1623 nt, Artificial Sequence
  derived and/or modified sequence opt4 from VP1__Norovirus__BAJ13615
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23141 - RNA, 1623 nt, Artificial Sequence
  derived and/or modified sequence opt4 from VP1__Norovirus__BAJ13618
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagagcccuguga

SEQ ID NO: 23142 - RNA, 1623 nt, Artificial Sequence; identical to SEQ ID NO: 22392
  derived and/or modified sequence opt4 from VP1__Norovirus__BAJ13621

SEQ ID NO: 23143 - RNA, 1623 nt, Artificial Sequence
  derived and/or modified sequence opt4 from VP1__Norovirus__BAJ13624
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucgccgugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23144 - RNA, 1623 nt, Artificial Sequence
  derived and/or modified sequence opt4 from VP1__Norovirus__BAJ13627
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagagacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcacccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23145 - RNA, 1623 nt, Artificial Sequence
  derived and/or modified sequence opt4 from VP1__Norovirus__BAJ13630
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaaggccggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23146 - RNA, 1623 nt, Artificial Sequence
  derived and/or modified sequence opt4 from VP1__Norovirus__BAJ13633
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccagauucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagugagcuga

SEQ ID NO: 23147 - RNA, 1623 nt, Artificial Sequence; identical to SEQ ID NO: 23122
  derived and/or modified sequence opt4 from VP1__Norovirus__BAJ13636

SEQ ID NO: 23148 - RNA, 1623 nt, Artificial Sequence
  derived and/or modified sequence opt4 from VP1__Norovirus__BAJ13639
augaagauggccagcaacgacgccaaccccagcgacggcagcgccgccaaccuggugcaggaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaucaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcggcaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23149 - RNA, 1623 nt, Artificial Sequence; identical to SEQ ID NO: 23122
  derived and/or modified sequence opt4 from VP1__Norovirus__BAJ13642

SEQ ID NO: 23150 - RNA, 1623 nt, Artificial Sequence
  derived and/or modified sequence opt4 from VP1__Norovirus__BAJ13648
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23151 - RNA, 1623 nt, Artificial Sequence
  derived and/or modified sequence opt4 from VP1__Norovirus__BAJ13651
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccagcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagcaucaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccaccagaacgagccccagcagugggugcugcccggcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23152 - RNA, 1623 nt, Artificial Sequence
  derived and/or modified sequence opt4 from VP1__Norovirus__BAJ13654
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccaucgagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagagacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaggcgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23153 - RNA, 1623 nt, Artificial Sequence
  derived and/or modified sequence opt4 from VP1__Norovirus__BAJ13657
augaagauggccagcaacgacgccagccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccagccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23154 - RNA, 1623 nt, Artificial Sequence
  derived and/or modified sequence opt4 from VP1__Norovirus__BAJ13660
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccccuggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagagacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugagauucagcaccgacaccgagaacgacuucgagacccaccagaacaccaaguucacccccgugggcgugauccaggacggcagcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23155 - RNA, 1623 nt, Artificial Sequence
  derived and/or modified sequence opt4 from VP1__Norovirus__BAJ13663
augaagauggccagcaacgacgccaaccccagcgacggcagcgccgccaaccuggugcccgaggugaacaacgagggcauggcccuggagcccguggugggcgccgccaucgccgcccccguggccggccagaccaacgugaucgaccccuggaucagaaacaacuucgugcaggcccccggcggcgaguucaccgugagccccagaaacgcccccagcgagauccuguggagcgccagccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcaacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaagcgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23156 - RNA, 1623 nt, Artificial Sequence
  derived and/or modified sequence opt4 from VP1__Norovirus__BAJ13666
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacaucacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgcccacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23157 - RNA, 1623 nt, Artificial Sequence
  derived and/or modified sequence opt4 from VP1__Norovirus__BAJ13669
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgccgacuucacccccaagcugggcagcgugcaguucggcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaacuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23158 - RNA, 1623 nt, Artificial Sequence
  derived and/or modified sequence opt4 from VP1__Norovirus__BAJ13672
augaagauggccagcaacgacgccaacagaagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaagcgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23159 - RNA, 1623 nt, Artificial Sequence
  derived and/or modified sequence opt4 from VP1__Norovirus__BAJ13675
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacagcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23160 - RNA, 1623 nt, Artificial Sequence
  derived and/or modified sequence opt4 from VP1__Norovirus__BAJ13678
augaagauggccagcaacgacgccaaccccagcgacggcagcgccgccaaccuggugcccgaggugaacaacgaggugauggcccuggagcccguggugggcgccgccaucgccgcccccguggccggccagaccaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagagacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgaggcccaccagaacaccaaguucacccccgugggcgugauccaggacggcagcaccacccacagaaacgagccccagcagugggugcugcccagcuacagcggcagaaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23161 - RNA, 1623 nt, Artificial Sequence
  derived and/or modified sequence opt4 from VP1__Norovirus__BAJ13681
augaagauggccagcaacgacgccagccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccaggacaccaaguucacccccgugggcgugauccaggacggcggcaccacccacagaaacgagccccagcagugggugcugcccagcuacagcggcagaaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23162 - RNA, 1623 nt, Artificial Sequence
  derived and/or modified sequence opt4 from VP1__Norovirus__BAJ13684
augaagauggccagcaacgacgccagccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggugagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggccuacaccggccagcacgaccuggugaucccccccaacggcuacuucagauucgacagcugggugaaccaguucuacacccuggcccccaugggcaacggcaccggcagaagaagagcccuguga

SEQ ID NO: 23163 - RNA, 1623 nt, Artificial Sequence
  derived and/or modified sequence opt4 from VP1__Norovirus__BAJ13687
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucaucgugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgccgacuucacccccaagcugggcagcgugcaguucggcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaacuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23164 - RNA, 1623 nt, Artificial Sequence
  derived and/or modified sequence opt4 from VP1__Norovirus__BAJ13690
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23165 - RNA, 1623 nt, Artificial Sequence
  derived and/or modified sequence opt4 from VP1__Norovirus__BAJ13693
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugaaggcccccggcggcgaguucaccgugagccccagaaacagccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucaucgugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggaggugcccgccccccugggcacccccgacuucgugggcaagauccagggcgugcugacccagaccaccaagggcgacggcagcaccagaggccacaaggccaccguguacaccggcagcgccgacuucacccccaagcugggcagcgugcaguucggcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaacuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23166 - RNA, 1623 nt, Artificial Sequence
  derived and/or modified sequence opt4 from VP1__Norovirus__BAJ13696
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccagauucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagugcuguga

SEQ ID NO: 23167 - RNA, 1623 nt, Artificial Sequence
  derived and/or modified sequence opt4 from VP1__Norovirus__BAJ13699
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccgcccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgccgacuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugaucccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagagcccuguga

SEQ ID NO: 23168 - RNA, 1623 nt, Artificial Sequence
  derived and/or modified sequence opt4 from VP1__Norovirus__BAJ13702
augaagauggccagcaacgacgccaaccccagcgacggcagcgccgccaaccuggugcccgaggugaacaacgaggugauggcccuggagcccguggugggcgccgccaucgccgcccccguggccggccagaccaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgaggcccaccagaacaccaaguucacccccgugggcgugauccaggacggcagcaccacccacagaaacgagccccagcagugggugcugcccagcuacagcggcagaaacgcccagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23169 - RNA, 1623 nt, Artificial Sequence
  derived and/or modified sequence opt4 from VP1__Norovirus__BAJ13711
augaagauggccagcaacgacgccaaccccagcgacggcagcgccgccaaccuggugcccgaggugaacaacgaggugauggcccuggagcccguggugggcgccgccaucgccgcccccguggccgcccagcagaacgugaucgaccccuggaucagaaacaacuucgugcaggcccccggcggcgaguucaccgugagccccagaaacgcccccagcgagauccuguggagcgccccccugggccccgaccugaaccccuaccugagccacuucgccagaauguacaacugcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23170 - RNA, 1623 nt, Artificial Sequence; identical to SEQ ID NO: 23134
  derived and/or modified sequence opt4 from VP1__Norovirus__BAJ13714

SEQ ID NO: 23171 - RNA, 1623 nt, Artificial Sequence
  derived and/or modified sequence opt4 from VP1__Norovirus__BAJ13717
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacguggccggcagcagaaacuacaucaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23172 - RNA, 1623 nt, Artificial Sequence
  derived and/or modified sequence opt4 from VP1__Norovirus__BAJ13720
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacgugugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagagacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23173 - RNA, 1623 nt, Artificial Sequence
  derived and/or modified sequence opt4 from VP1__Norovirus__BAJ13723
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagagacuacaccaugaaccuggccagccugaacuggaacaacuacgaccccaccgaggagauccccgccccccugggcacccccgacuucgugggcaagauccagggcgugcugacccagaccaccagaggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23174 - RNA, 1623 nt, Artificial Sequence
  derived and/or modified sequence opt4 from VP1__Norovirus__BAJ13726
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23175 - RNA, 1623 nt, Artificial Sequence; identical to SEQ ID NO: 23134
  derived and/or modified sequence opt4 from VP1__Norovirus__BAJ13729

SEQ ID NO: 23176 - RNA, 1623 nt, Artificial Sequence; identical to SEQ ID NO: 23085
  derived and/or modified sequence opt4 from VP1__Norovirus__BAJ13732

SEQ ID NO: 23177 - RNA, 1623 nt, Artificial Sequence; identical to SEQ ID NO: 22392
  derived and/or modified sequence opt4 from VP1__Norovirus__BAJ13738

SEQ ID NO: 23178 - RNA, 1623 nt, Artificial Sequence
  derived and/or modified sequence opt4 from VP1__Norovirus__BAJ13741
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccaguacgaccuggugaucccccccaacggcuacuucagauucgacagcugggugaaccaguucuacacccuggcccccaugggcaacggcaccggcagaagaagagcccuguga

SEQ ID NO: 23179 - RNA, 1623 nt, Artificial Sequence; identical to SEQ ID NO: 23122
  derived and/or modified sequence opt4 from VP1__Norovirus__BAJ13744

SEQ ID NO: 23180 - RNA, 1623 nt, Artificial Sequence; identical to SEQ ID NO: 22612
  derived and/or modified sequence opt4 from VP1__Norovirus__BAJ13747

SEQ ID NO: 23181 - RNA, 1623 nt, Artificial Sequence; identical to SEQ ID NO: 22671
  derived and/or modified sequence opt4 from VP1__Norovirus__BAJ13750

SEQ ID NO: 23182 - RNA, 1623 nt, Artificial Sequence; identical to SEQ ID NO: 22612
  derived and/or modified sequence opt4 from VP1__Norovirus__BAJ13753

SEQ ID NO: 23183 - RNA, 1623 nt, Artificial Sequence
  derived and/or modified sequence opt4 from VP1__Norovirus__BAJ13756
augaagauggccagcagcgacgccaacccccccgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaagcuacaccaugaaccuggccagccugaacuggaacaacuacgaccccaccgaggagauccccgccccccugggcacccccgacuucgugggcaagauccagggcaugcugacccagaccaccaagggcgacggcagcaccagaggccacaaggccaccguguacaccggcagcgcccccuucacccccaagcugggcagcgugcaguucagcaccgacaccgagaacgacuuccagacccaccagaacaccaaguucacccccgugggcgugauccaggacggcagcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23184 - RNA, 1623 nt, Artificial Sequence
  derived and/or modified sequence opt4 from VP1__Norovirus__BAJ13759
augaagauggccagcaacgacgccaaccccagcgacggcagcgccgccagccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23185 - RNA, 1623 nt, Artificial Sequence; identical to SEQ ID NO: 22671
  derived and/or modified sequence opt4 from VP1__Norovirus__BAJ13762

SEQ ID NO: 23186 - RNA, 1623 nt, Artificial Sequence; identical to SEQ ID NO: 22671
  derived and/or modified sequence opt4 from VP1__Norovirus__BAJ13765

SEQ ID NO: 23187 - RNA, 1623 nt, Artificial Sequence; identical to SEQ ID NO: 23174
  derived and/or modified sequence opt4 from VP1__Norovirus__BAJ13768

SEQ ID NO: 23188 - RNA, 1623 nt, Artificial Sequence
  derived and/or modified sequence opt4 from VP1__Norovirus__BAJ13771
augaagauggccagcaacgacgccaaccccagcgacggcagcgccgccaaccuggugcccgaggugaacaacgaggugauggcccuggagcccguggugggcgccgccaucgccgcccccguggccggccagaccaacgugaucgaccccuggaucagaaacaacuucgugcaggcccccggcggcgaguucaccgugagccccagaaacgcccccggcgagauccuguggagcgccgcccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23189 - RNA, 1623 nt, Artificial Sequence; identical to SEQ ID NO: 23122
  derived and/or modified sequence opt4 from VP1__Norovirus__BAJ13774

SEQ ID NO: 23190 - RNA, 1623 nt, Artificial Sequence
  derived and/or modified sequence opt4 from VP1__Norovirus__BAJ13777
augaagauggccagcaacgacgccaaccccagcgacggcagcgccgccaaccuggugcccgaggugaacaacgaggugauggcccuggagcccguggugggcgccgccaucgccgcccccguggccggccagaccaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgaggcccaccagaacaccaaguucacccccgugggcgugauccaggacggcagcaccacccacagaaacgagccccagcagugggugcugcccagcuacagcggcagaaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23191 - RNA, 1623 nt, Artificial Sequence; identical to SEQ ID NO: 23122
  derived and/or modified sequence opt4 from VP1__Norovirus__BAJ13780

SEQ ID NO: 23192 - RNA, 1623 nt, Artificial Sequence; identical to SEQ ID NO: 23122
  derived and/or modified sequence opt4 from VP1__Norovirus__BAJ13783

SEQ ID NO: 23193 - RNA, 1623 nt, Artificial Sequence; identical to SEQ ID NO: 22671
  derived and/or modified sequence opt4 from VP1__Norovirus__BAJ13786

SEQ ID NO: 23194 - RNA, 1623 nt, Artificial Sequence
  derived and/or modified sequence opt4 from VP1__Norovirus__BAJ13792
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcagguggugcuggccggcaacgccuucaccgccggcaaggugaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcacccccuucacccccaagcugggcagcgugcaguucagcaccgacaccgagaacgacuucgagaaccaccagaacaccaaguucacccccgugggcgugauccaggacggcggcaccacccacagaaacgagccccagcagugggugcugcccagcuacagcggcagaaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23195 - RNA, 1623 nt, Artificial Sequence
  derived and/or modified sequence opt4 from VP1__Norovirus__BAJ13795
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccccuggagcgccccccugggccccgaccugaaccccuaccugagccaccuggccagaauguacaacggcuacgccggcggcuucgaggugcagguggugcuggccggcaacgccuucaccgccggcaaggugaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcacccccuucacccccaagcugggcagcgugcaguucagcaccgacaccgagaacgacuucgagaaccaccagaacaccaaguucacccccgugggcgugauccaggacggcggcaccacccacagaaacgagccccagcagugggugcugcccagcuacagcggcagaaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23196 - RNA, 1623 nt, Artificial Sequence
  derived and/or modified sequence opt4 from VP1__Norovirus__BAJ13801
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcagguggugcuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcacccccuucacccccaagcugggcagcgugcaguucagcaccgacaccgagaacgacuucgagaaccaccagaacaccaaguucacccccgugggcgugauccaggacggcggcaccacccacagaaacgagccccagcagugggugcugcccagcuacagcggcagaaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23197 - RNA, 1623 nt, Artificial Sequence
  derived and/or modified sequence opt4 from VP1__Norovirus__BAJ13804
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23198 - RNA, 1623 nt, Artificial Sequence; identical to SEQ ID NO: 22671
  derived and/or modified sequence opt4 from VP1__Norovirus__BAJ13807

SEQ ID NO: 23199 - RNA, 1623 nt, Artificial Sequence; identical to SEQ ID NO: 23197
  derived and/or modified sequence opt4 from VP1__Norovirus__BAJ13810

SEQ ID NO: 23200 - RNA, 1623 nt, Artificial Sequence; identical to SEQ ID NO: 23197
  derived and/or modified sequence opt4 from VP1__Norovirus__BAJ13816

SEQ ID NO: 23201 - RNA, 1623 nt, Artificial Sequence
  derived and/or modified sequence opt4 from VP1__Norovirus__BAJ13819
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugauccacaucgccggcagcagaaacuacaccaugaaccuggccgcccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgccgacuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23202 - RNA, 1623 nt, Artificial Sequence; identical to SEQ ID NO: 23197
  derived and/or modified sequence opt4 from VP1__Norovirus__BAJ13822

SEQ ID NO: 23203 - RNA, 1623 nt, Artificial Sequence
  derived and/or modified sequence opt4 from VP1__Norovirus__BAJ13825
augaagauggccagcaacgacgccaaccccagcgacggcagcgccgccaaccuggugcccgaggugaacaacgaggugauggcccuggagcccguggugggcgccgccaucgccgcccccguggccggccagaccaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccugaccccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgaggcccaccagaacaccaaguucacccccgugggcgugauccaggacggcagcaccacccacagaaacgagccccagcagugggugcugcccagcuacagcggcagaaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgaccuggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23204 - RNA, 1623 nt, Artificial Sequence
  derived and/or modified sequence opt4 from VP1__Norovirus__BAJ13828
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcacagccuguacuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23205 - RNA, 1623 nt, Artificial Sequence; identical to SEQ ID NO: 22671
  derived and/or modified sequence opt4 from VP1__Norovirus__BAJ13831

SEQ ID NO: 23206 - RNA, 1623 nt, Artificial Sequence; identical to SEQ ID NO: 22392
  derived and/or modified sequence opt4 from VP1__Norovirus__BAJ13834

SEQ ID NO: 23207 - RNA, 1623 nt, Artificial Sequence; identical to SEQ ID NO: 22671
  derived and/or modified sequence opt4 from VP1__Norovirus__BAJ13837

SEQ ID NO: 23208 - RNA, 1623 nt, Artificial Sequence
  derived and/or modified sequence opt4 from VP1__Norovirus__BAJ13840
augaagauggccagcaacgacgccagccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccgcccugaacuggaacaacuacgaccccaccgaggagauccccgccccccugggcacccccgacuucgugggcaagauccagggcgugcugacccagaccaccaaggccgacggcagcaccagaggccacaaggccaccguguacaccggcagcgccguguucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23209 - RNA, 1623 nt, Artificial Sequence; identical to SEQ ID NO: 22671
  derived and/or modified sequence opt4 from VP1__Norovirus__BAJ13843

SEQ ID NO: 23210 - RNA, 1623 nt, Artificial Sequence; identical to SEQ ID NO: 22671
  derived and/or modified sequence opt4 from VP1__Norovirus__BAJ13846

SEQ ID NO: 23211 - RNA, 1623 nt, Artificial Sequence; identical to SEQ ID NO: 22671
  derived and/or modified sequence opt4 from VP1__Norovirus__BAJ13849

SEQ ID NO: 23212 - RNA, 1623 nt, Artificial Sequence
  derived and/or modified sequence opt4 from VP1__Norovirus__BAJ13852
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagcccggcuacgugaccguggcccacaccggccagcacgaccuggugauccccagcaacggcuacuucagauucgacagcugggugaaccaguucuacacccuggcccccaugggcaacggcaccggcagaagaagagcccuguga

SEQ ID NO: 23213 - RNA, 1623 nt, Artificial Sequence
  derived and/or modified sequence opt4 from VP1__Norovirus__BAJ13855
augaagauggccagcaacgacgccaaccccagcgacggcagcgccgccaaccuggugcccgaggugaacaacgaggugauggcccuggaccccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucugccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23214 - RNA, 1623 nt, Artificial Sequence; identical to SEQ ID NO: 22535
  derived and/or modified sequence opt4 from VP1__Norovirus__BAJ13858

SEQ ID NO: 23215 - RNA, 1623 nt, Artificial Sequence
  derived and/or modified sequence opt4 from VP1__Norovirus__BAJ13861
augaagaugagaagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccggcagcugcagagugcugaccagacccagccccgacuucgacuucaucuuccuggugccccccaccguggagagcagaaccaagcccuucagcgugagcuucuucaccggcgaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccacccagaacuggaacagcuacgaccccaccgaggagauccccgccccccugggcacccccgacuucgugggcaagauccagggcgugcugacccagaccaccagagccgacggcagcaccagaggccacaaggccaccguguacaccggcagcgccgacuucgcccccaagcugggcagagugcaguucgccaccgacaccgacaacgacuucgacgccaaccagaacaccaaguucacccccgugggcgugauccaggacggcgacaccgcccacagaaacgagccccagcagugggugcugcccagcuacagcggcagaaacagccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23216 - RNA, 1623 nt, Artificial Sequence; identical to SEQ ID NO: 22535
  derived and/or modified sequence opt4 from VP1__Norovirus__BAJ13864

SEQ ID NO: 23217 - RNA, 1623 nt, Artificial Sequence
  derived and/or modified sequence opt4 from VP1__Norovirus__BAJ13867
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacugcauccuggaccugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccacccagaacuggaacagcuacgaccccaccgaggagauccccgccccccugggcacccccgacuucgugggcaagauccagggcgugcugacccagaccaccagagccgacggcagcaccagaggccacaaggccaccguguacaccggcagcgccgacuucgcccccaagcugggcagagugcaguucgccaccgacaccgacaacgacuucgacgccaaccagaacaccaaguucacccccgugggcgugauccaggacggcgacaccgcccacagaaacgagccccagcagugggugcugcccagcuacagcggcagaaacagccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23218 - RNA, 1623 nt, Artificial Sequence
  derived and/or modified sequence opt4 from VP1__Norovirus__BAJ13873
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggugguguucaccgugagcugcagagugcugaccagacccagccccgacuucgacuucaucugccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagcccggcuacgugaccguggcccacaccggccagcacgaccuggugauccccagcaacggcuacuucagauucgacagcugggugaaccaguucuacacccuggcccccaugggcaacggcaccggcagaagaagagcccuguga

SEQ ID NO: 23219 - RNA, 1623 nt, Artificial Sequence
  derived and/or modified sequence opt4 from VP1__Norovirus__BAJ13876
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccgcccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgccgacuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23220 - RNA, 1623 nt, Artificial Sequence
  derived and/or modified sequence opt4 from VP1__Norovirus__BAJ13879
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccauggaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23221 - RNA, 1623 nt, Artificial Sequence; identical to SEQ ID NO: 22392
  derived and/or modified sequence opt4 from VP1__Norovirus__BAJ13882

SEQ ID NO: 23222 - RNA, 1623 nt, Artificial Sequence
  derived and/or modified sequence opt4 from VP1__Norovirus__BAJ13885
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccacccagaacuggaacagcuacgaccccaccgaggagauccccgccccccugggcacccccgacuucgugggcaagauccagggcgugcugacccagaccaccagagccgacggcagcaccagaggccacaaggccaccguguacaccggcagcgccgacuucgcccccaagcugggcagagugcaguucgccaccgacaccgacaacgacuucgacgccaaccagaacaccaaguucacccccgugggcgugauccaggacggcaacaccgcccacagaaacgagccccagcagugggugcugcccagcuacagcggcagaaacagccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23223 - RNA, 1623 nt, Artificial Sequence
  derived and/or modified sequence opt4 from VP1__Norovirus__BAJ13891
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggccagcagaaccaagcccuucagcgugcccagcgugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccacccagaacuggaacagcuacgaccccaccgaggagauccccgccccccugggcacccccgacuucgugggcaagauccagggcgugcugacccagaccaccagagccgacggcagcaccagaggccacaaggccaccguguacaccggcagcgccgacuucgcccccaagcugggcagagugcaguucgccaccgacaccgacaacgacuucgacgccaaccagaacaccaaguucacccccgugggcgugauccaggacggcgacaccgcccacagaaacgagccccagcagugggugcugcccagcuacagcggcagaaacagccacaacgugcaccuggcccccaccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23224 - RNA, 1623 nt, Artificial Sequence
  derived and/or modified sequence opt4 from VP1__Norovirus__BAJ13894
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagcccccagaacgcccccagcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagagacuguacaccggccccagcagcgccuucguggugcagccccagaacggcagaugcaccaccgacggcgugcugcugggcaccacccagcugagcgccgugaacaucugcaccuucagaggcgacgugacccacaucgccggcagcagaaacuacaccaugaaccuggccagccagaacuggaacaacuacgaccccaccgaggagauccccgccccccugggcacccccgacuucgugggcaagauccagggcaugcugacccagaccaccagaagcgacggcagcaccagaggccacaaggccaccgugcugaccggcagcgccgacuucgcccccaagcugggcagagugcaguucgccaccgacaccgacaacgacuucgagagcggccagaacaccaaguucacccccgugggcgugauccaggacggcagcaccacccacagaaacgagccccagcagugggugcugcccaacuacagcggcagaaccggccacaacgugcaccuggcccccgccguggcccccaccuaccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagccguguga

SEQ ID NO: 23225 - RNA, 1623 nt, Artificial Sequence
  derived and/or modified sequence opt4 from VP1__Norovirus__BAJ13897
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccacccagaacuggaacagcuacgaccccaccgaggagauccccgccccccugggcacccccgacuucgugggcaagauccagggcgugcugacccagaccaccagagccgacggcagcaccagaggccacaaggccaccguguacaccggcagcgccgacuucgcccccaagcugggcagagugcaguucgccaccgacaccgacaacgacuucgacgccaaccagaacaccaaguucacccccgugggcgugauccaggacggcgacaccgcccacagaaacgagccccagcagugggugcugcccagcuacagcggcagaaacagccacaacgugcaccuggcccccaccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23226 - RNA, 1623 nt, Artificial Sequence
  derived and/or modified sequence opt4 from VP1__Norovirus__BAJ13900
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagagacuguacaccggccccagcagcgccuucguggugcagccccagaacggcagaugcaccaccgacggcgugcugcugggcaccacccagcugagcgccgugaacaucugcaccuucagaggcgacgugacccacaucgccggcagcagaaacuacaccaugaaccuggccagccagaacuggaacaacuacgaccccaccgaggagauccccgccccccugggcacccccgacuucgugggcaagauccagggcaugcugacccagaccaccagaagcgacggcagcaccagaggccacaaggccaccgugcugaccggcagcgccgacuucgcccccaagcugggcagagugcaguucgccaccgacaccgacaacgacuucgagagcggccagaacaccaaguucacccccgugggcgugauccaggacggcagcaccacccacagaaacgagccccagcagugggugcugcccaacuacagcggcagaaccggccacaacgugcaccuggcccccgccguggcccccaccuaccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagccguguga

SEQ ID NO: 23227 - RNA, 1623 nt, Artificial Sequence; identical to SEQ ID NO: 23219
  derived and/or modified sequence opt4 from VP1__Norovirus__BAJ13903

SEQ ID NO: 23228 - RNA, 1623 nt, Artificial Sequence; identical to SEQ ID NO: 23226
  derived and/or modified sequence opt4 from VP1__Norovirus__BAJ13906

SEQ ID NO: 23229 - RNA, 1623 nt, Artificial Sequence
  derived and/or modified sequence opt4 from VP1__Norovirus__BAJ13909
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgccgacuucacccccaagcugggcagcgugcaguucgccaccgacaccgagaacgacuucgagacccaccagaacaccaaguucacccccgugggcgugauccaggacggcggcaccacccacagaaacgagccccagcagugggugcugcccagcuacagcggcagaaacgugcacaacgugcaccuggcccccgccguggcccccaacuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23230 - RNA, 1623 nt, Artificial Sequence; identical to SEQ ID NO: 22392
  derived and/or modified sequence opt4 from VP1__Norovirus__BAJ13912

SEQ ID NO: 23231 - RNA, 1623 nt, Artificial Sequence; identical to SEQ ID NO: 23157
  derived and/or modified sequence opt4 from VP1__Norovirus__BAJ13918

SEQ ID NO: 23232 - RNA, 1623 nt, Artificial Sequence
  derived and/or modified sequence opt4 from VP1__Norovirus__BAJ13924
augaagauggccagcaacgacgccagccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23233 - RNA, 1623 nt, Artificial Sequence
  derived and/or modified sequence opt4 from VP1__Norovirus__BAJ13927
augaagauggccagcaacgacgccaaccccagcgacggcagcgccgccaaccuggugcccgaggugaacaacgaggugauggcccuggagcccguggugggcgccgccaucgccgcccccguggccggccagaccaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcggcgcccccuucacccccaagcugggcagcgcccaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23234 - RNA, 1623 nt, Artificial Sequence
  derived and/or modified sequence opt4 from VP1__Norovirus__BAJ13930
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccuggaccccgaccugaaccccuaccugagccagcuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23235 - RNA, 1623 nt, Artificial Sequence; identical to SEQ ID NO: 22535
  derived and/or modified sequence opt4 from VP1__Norovirus__BAJ13933

SEQ ID NO: 23236 - RNA, 1623 nt, Artificial Sequence; identical to SEQ ID NO: 22392
  derived and/or modified sequence opt4 from VP1__Norovirus__BAJ13936

SEQ ID NO: 23237 - RNA, 1623 nt, Artificial Sequence; identical to SEQ ID NO: 22671
  derived and/or modified sequence opt4 from VP1__Norovirus__BAJ13939

SEQ ID NO: 23238 - RNA, 1623 nt, Artificial Sequence
  derived and/or modified sequence opt4 from VP1__Norovirus__BAJ13942
augaagauggccagcaacgacgccaaccccagcgacggcagcgccgccaaccuggugcccgaggugaacaacgaggugauggcccuggagcccguggugggcgccgccaucgccgcccccguggccggccagaccaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagagacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23239 - RNA, 1623 nt, Artificial Sequence; identical to SEQ ID NO: 23197
  derived and/or modified sequence opt4 from VP1__Norovirus__BAJ13945

SEQ ID NO: 23240 - RNA, 1623 nt, Artificial Sequence
  derived and/or modified sequence opt4 from VP1__Norovirus__BAJ13948
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcaacaccacccacagaaacgagccccagcagugggugcugcccagcuacagcggcagaaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23241 - RNA, 1623 nt, Artificial Sequence; identical to SEQ ID NO: 22535
  derived and/or modified sequence opt4 from VP1__Norovirus__BAJ13951

SEQ ID NO: 23242 - RNA, 1623 nt, Artificial Sequence
  derived and/or modified sequence opt4 from VP1__Norovirus__BAJ13954
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcaugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcaacaccacccacagaaacgagccccagcagugggugcugcccagcuacagcggcagaaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23243 - RNA, 1623 nt, Artificial Sequence
  derived and/or modified sequence opt4 from VP1__Norovirus__BAJ13957
augaagauggccagcaacgacgccaaccccagcgacggcagcgccgccaaccuggugcccgaggugaacaacgaggugauggcccuggagcccguggugggcgccgccaucgccgcccccguggccggccagaccaacgugaucgaccccuggaucagaaacaacuucgugcaggcccccggcggcgaguucaccgugagccccagaaacgcccccggcgagauccuguggagcgcccccagcggccccgaccugaaccccuaccugagccaccuggccagaauguucaacgacuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgaggcccaccagaacaccaaguucacccccgugggcgugauccaggacggcagcaccacccacagaaacgagccccagcagugggugcugcccagcuacagcggcagaaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23244 - RNA, 1623 nt, Artificial Sequence; identical to SEQ ID NO: 22671
  derived and/or modified sequence opt4 from VP1__Norovirus__BAJ13960

SEQ ID NO: 23245 - RNA, 1623 nt, Artificial Sequence; identical to SEQ ID NO: 22671
  derived and/or modified sequence opt4 from VP1__Norovirus__BAJ13963

SEQ ID NO: 23246 - RNA, 1623 nt, Artificial Sequence; identical to SEQ ID NO: 23157
  derived and/or modified sequence opt4 from VP1__Norovirus__BAJ13966

SEQ ID NO: 23247 - RNA, 1623 nt, Artificial Sequence; identical to SEQ ID NO: 22392
  derived and/or modified sequence opt4 from VP1__Norovirus__BAJ13969

SEQ ID NO: 23248 - RNA, 1623 nt, Artificial Sequence
  derived and/or modified sequence opt4 from VP1__Norovirus__BAJ13972
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagagacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgugcccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23249 - RNA, 1623 nt, Artificial Sequence
  derived and/or modified sequence opt4 from VP1__Norovirus__BAJ13975
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgccgacuucacccccaagcugggcagcgugcaguucgccaccgacaccgagaacgacuucgagacccaccagaacaccaaguucacccccgugggcgugauccaggacggcggcaccacccacagaaacgagccccagcagugggugcugcccagcuacagcggcagaaacgugcacaacgugcaccuggcccccgccguggcccccaacuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23250 - RNA, 1623 nt, Artificial Sequence
  derived and/or modified sequence opt4 from VP1__Norovirus__BAJ13978
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcacccccuucacccccaagcugggcagcgugcaguucagcaccgacaccgagaacgacuucgagacccaccagaacaccaaguucacccccgugggcgugauccaggacggcagcaccauccacagaaacgagccccagcagugggugcugcccagcuacagcggcagaaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23251 - RNA, 1623 nt, Artificial Sequence; identical to SEQ ID NO: 22671
  derived and/or modified sequence opt4 from VP1__Norovirus__BAJ13981

SEQ ID NO: 23252 - RNA, 1623 nt, Artificial Sequence; identical to SEQ ID NO: 22392
  derived and/or modified sequence opt4 from VP1__Norovirus__BAJ13984

SEQ ID NO: 23253 - RNA, 1623 nt, Artificial Sequence; identical to SEQ ID NO: 22392
  derived and/or modified sequence opt4 from VP1__Norovirus__BAJ13987

SEQ ID NO: 23254 - RNA, 1623 nt, Artificial Sequence
  derived and/or modified sequence opt4 from VP1__Norovirus__BAJ13990
augaagauggccagcaacgacgccagccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23255 - RNA, 1623 nt, Artificial Sequence; identical to SEQ ID NO: 22392
  derived and/or modified sequence opt4 from VP1__Norovirus__BAJ13993

SEQ ID NO: 23256 - RNA, 1623 nt, Artificial Sequence; identical to SEQ ID NO: 23197
  derived and/or modified sequence opt4 from VP1__Norovirus__BAJ13996

SEQ ID NO: 23257 - RNA, 1623 nt, Artificial Sequence; identical to SEQ ID NO: 23134
  derived and/or modified sequence opt4 from VP1__Norovirus__BAJ13999

SEQ ID NO: 23258 - RNA, 1623 nt, Artificial Sequence; identical to SEQ ID NO: 23197
  derived and/or modified sequence opt4 from VP1__Norovirus__BAJ14002

SEQ ID NO: 23259 - RNA, 1623 nt, Artificial Sequence
  derived and/or modified sequence opt4 from VP1__Norovirus__BAJ14005
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcugauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagauccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggccuacaccggccagcacgaccuggugaucccccccaacggcuacuucagauucgacagcugggugaaccaguucuacacccuggcccccaugggcaacggcaccggcagaagaagagcccuguga

SEQ ID NO: 23260 - RNA, 1623 nt, Artificial Sequence
  derived and/or modified sequence opt4 from VP1__Norovirus__BAJ14008
augaagauggccagcaacgacgccaaccccagcgacggcagcgccgccaaccuggugcccgaggugaacaacgaggugauggcccuggagcccguggugggcgccgccaucgccgcccccguggccggccagaccaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccgugcugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgagguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23261 - RNA, 1623 nt, Artificial Sequence
  derived and/or modified sequence opt4 from VP1__Norovirus__BAJ14011
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagauccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggccuacaccggccagcacgaccuggugaucccccccaacggcuacuucagauucgacagcugggugaaccaguucuacacccuggcccccaugggcaacggcaccggcagaagaagagcccuguga

SEQ ID NO: 23262 - RNA, 1623 nt, Artificial Sequence; identical to SEQ ID NO: 22392
  derived and/or modified sequence opt4 from VP1__Norovirus__BAJ14014

SEQ ID NO: 23263 - RNA, 1623 nt, Artificial Sequence
  derived and/or modified sequence opt4 from VP1__Norovirus__BAK43269
auggccagcaacgacgccgcccccagcaccgacggcgccgccggccuggugcccgagagcaacaacgaggugauggcccuggagcccguggccggcgccgcccuggccgcccccgugaccggccagaccaacaucaucgaccccuggaucagagccaacuucgugcaggcccccaacggcgaguucaccgugagccccagaaacgcccccggcgaggugcugcugaaccuggagcugggccccgagcugaaccccuaccuggcccaccuggccagacuguacaacggcuacgccggcggcauggaggugcaggugaugcuggccggcaacgccuucaccgccggcaagcugguguuccccgccgugcccccccacuuccccaucgagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauuccccgugagcaucgaccagauguacaccagccccaacgaggugaucagcgugcagugccagaacggcagaugcacccuggacggcgagcugcagggcaccacccagcugcaggugagcggcaucugcgccuucaagggcgaggugaccgcccaccugcacgacaacgaccaccuguacaacaucaccaucaccaaccugaacggcagccccuucgaccccagcgaggacauccccgccccccugggcgugcccgacuuccagggcagaguguucggcaucaucagccagagagacaagcacaacagccccggccacaacgagcccgccaacagaggccacgacgccguggugcccaccuacaccgcccaguacacccccaagcugggccagauccagaucggcaccuggcagaccgacgaccugaccgugagccagcccgugaaguucacccccgugggccugaacgacaucgagcacuucaaccaguggguggugcccagauacgccggcgcccugaaccugaacaccaaccuggcccccagcguggcccccguguuccccggcgagagacugcuguucuucagaagcuacaucccccugaagggcggcuacggcaaccccgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagagugcaguga

SEQ ID NO: 23264 - RNA, 1623 nt, Artificial Sequence
  derived and/or modified sequence opt4 from VP1__Norovirus__BAK43272
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacacccagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcagauacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23265 - RNA, 1647 nt, Artificial Sequence
  derived and/or modified sequence opt4 from VP1__Norovirus__BAK43275
augaagauggccagcaacgacgccgcccccagcaacgacggcgccgccggccuggugcccgagaucaacaacgaggccauggcccuggagcccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgccuucaccgccggcaagaucaucuucgccgccaucccccccaacuuccccaucgacaaccugagcgccgcccagaucaccaugugcccccacgugaucguggacgugagacagcuggagcccgugaaccugcccaugcccgacgugagaaacaacuucuuccacuacaaccagggcagcgacagcagacugagacugguggccaugcuguacaccccccugagagccaacaacagcggcgacgacguguucaccgugagcugcagagugcugaccagacccagccccgacuucagcuucaacuuccuggugccccccaccguggagagcaagaccaagcccuucacccugcccauccugaccaucagcgagaugagcaacagcagauuccccgugcccaucgacagccugcacaccagccccaccgagaacaucguggugcagugccagaacggcagagugacccuggacggcgagcugaugggcaccacccagcugcugcccagccagaucugcgccuucagaggcgugcugaccagaagcaccagcagagccagcgaccaggccgacaccgccacccccagacuguucaacuacuacuggcacauccagcuggccaaccugaacggcacccccuacgaccccgccgaggacauccccggcccccugggcacccccgacuucagaggcaagguguucggcguggccugccagagaaaccccgacugcaccaccagagcccacgaggccaagguggacaccaccgccggcagauucacccccaagcugggcagccuggagaucagcaccgagagcggcgacuucgaccagaaccagcccaccagauucacccccgugggcaucggcguggaccacgaggccgacuuccagcaguggagccugcccgacuacagcggccaguucacccacaacaugaaccuggcccccgccguggcccccaacuuccccggcgagcagcugcuguucuucagaagccagcugcccagcagcggcggcagaagcaacggcauccuggacugccuggugccccaggagugggugcagcacuucuaccaggagagcgcccccgcccagacccagguggcccuggugagauacgugaaccccgacaccggcagagugcuguucgaggccaagcugcacaagcugggcuucaugaccaucgccaagaacggcgacagccccaucaccgugccccccaacggcuacuucagauucgagagcugggugaaccccuucuacacccuggcccccaugggcaccggcaacggcagaagaagaauccaguga

SEQ ID NO: 23266 - RNA, 1623 nt, Artificial Sequence
  derived and/or modified sequence opt4 from VP1__Norovirus__BAK43278
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcagcuacgugaccguggcccacaccggccagcacgaccuggugaucccccccaacggcuacuucagauucgacagcugggugaaccaguucuacacccuggcccccaugggcaacggcaccggcagaagacacgcccuguga

SEQ ID NO: 23267 - RNA, 1623 nt, Artificial Sequence
  derived and/or modified sequence opt4 from VP1__Norovirus__BAK43284
auggccagcaacgacgccgcccccagcaccgacggcgccgccggccuggugcccgagagcaacaacgaggugauggcccuggagcccguggccggcgccgcccuggccgcccccgugaccggccagaccaacaucaucgaccccuggaucagagccaacuucgugcaggcccccaacggcgaguucaccgugagccccagaaacgcccccggcgaggugcugcugagccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccguggagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauucaccgugagcaucgaccagauguacaccagccugaacgaggugaucagcgugcagugccagaacggcagaugcacccuggacggcgagcugagaggcaccacccagcugcaggugagcggcaucugcgccuucaagggcgaggugaccgcccacgugcacgacaacgaccaccuguacaacgugaccaucaccaaccugaacggcagccccuucgaccccagcgaggacgugcccgccccccugggcgugcccgacuuccagggcagaguguucggcaucaucagccagagagacaagcacaacagccccggccacaacgagcccgccaacagaggccacgacgccguggugcccaccuacaccgcccaguacacccccaagcugggccagauccagaucggcaccuggcagaccgacgaccugaccgugaaccagcccgugaaguucacccccgugggccugaacgacaccgagcacuucaaccaguggguggugcccagauacgccggcgcccugaaccugaacaccaaccuggcccccagcguggcccccguguuccccggcgagagacugcuguucuucagaagcuacgugccccugaagggcggcuacggcaaccccgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagagugcaguga

SEQ ID NO: 23268 - RNA, 1644 nt, Artificial Sequence
  derived and/or modified sequence opt4 from VP1__Norovirus__BAL14785
augaagauggccagcaacgacgccgcccccagcaacgacggcgccgccaaccuggugcccgaggccaacaacgaggugauggcccuggagcccguggugggcgccagcaucgccgcccccguggugggccagcagaacaucaucgaccccuggaucagagagaacuucgugcaggccccccagggcgaguucaccgugagccccagaaacagccccggcgagaugcugcugaaccuggagcugggccccgagcugaaccccuaccugagccaccugagcagaauguacaacggcuacgccggcggcaugcaggugcagguggugcuggccggcaacgccuucaccgccggcaagaucaucuucgccgccgugcccccccacuuccccguggagaacaucagcgccgcccagaucaccaugugcccccacgugaucguggacgugagacagcuggagcccgugcugcugccccugcccgacaucagaaacagauucuuccacuacaaccaggagaacacccccagaaugagacugguggccaugcuguacaccccccugagagccaacagcggcgaggacguguucaccgugagcugcagagugcugaccagacccgcccccgacuucgaguucaccuuccuggugccccccaccguggagagcaagaccaagcccuucacccugcccauccugacccugggcgagcugagcaacagcagauuccccgcccccaucgacaugcuguacaccgaccccaacgagggcaucguggugcagccccagaacggcagaugcacccuggacggcacccugcagggcaccacccagcuggugcccacccagaucugcgccuucagaggcacccugaucggccagaccagcagaagcagcgacagcaccgacagcgcccccagaagaagagaccacccccugcacgugcagcugaagaaccuggacggcacccaguacgaccccaccgacgaggugcccgccgugcugggcgccaucgacuucaagggcaccguguucggcguggccagccagagagacgugagcggccagcaggugggcgccaccagagcccacgaggugcacaucagcaccaccgaccccagauacacccccaagcugggcagcauccugaugagaagcgagagcgacgacuucgugaccggccagcccgugagauucacccccaucggcaugggcgacaacgacuggcaccagugggagcugcccgacuacagcggccaccugacccugaacaugaaccuggcccccgccguggcccccgccuuccccggcgagagaauccuguucuucagaagcauggugcccagcgccggcggcuacggcagcggccagaucgacugccugaucccccaggagugggugcagcacuucuaccaggaggccgcccccagccagagcgccguggcccugaucagauacgugaaccccgacaccggcagaaacaucuucgaggccaagcugcacagagagggcuucaucaccguggccaacagcggcaacaaccccaucguggugccccccaacggcuacuucagauucgaggccugggugaaccaguucuacacccugacccccaugggcaccggccagggcagaagaagaaaccaguga

SEQ ID NO: 23269 - RNA, 1749 nt, Artificial Sequence
  derived and/or modified sequence opt4 from VP1__Norovirus__BAR88157
augaagauggccagcagcgacgccgccagccccagcagcgacggcgccgccaaccuggugcccgagaucaacaacgaggugauggcccuggagcccguggccggcgcccagcuggccgcccccguggccgaccaguucaacgccaucgaccccuggaucagacagaacuucgugcaggcccccgagggcgaguucaccgugagccccagaaacgcccccggcgagauccugcugaaccuggagcugggcccccaccugaaccccuuccugcagcaccuggcccagauguacaacgccuacgccggcggcauggaggugcagguggugcuggccggcaacgccuucaccgccggcaagaucaucuucgccgccauccccccccacuucccccccgagagacugagcgccgcccaggccacccaguucccccacgugaucaucgacgugagacagcuggagcccaucgugcugccccugcccgacgugagacacaaccuguuccacuucaaccagcagaacgacgagagaaugagacugguggccuuccuguacaccccccugagagccaacagcggcagcggcgacgacguguucaccgugagcugcagagugcugaccagacccagccccgacuucgaguucauguuccuggugccccccaccguggagagaaagaccguggccuucagccugccccagcugaccgugggcgagaugagcaacagcagauggcccgccagaaucaccaccaugaucgccgacccccaccugccccaggugcugagaauccagaacggcagaugcacccuggacggcacccugaugggcaccacccagcugaaccccaacgacaucugcagagugagaggcuacuucagcaacagcagaccccaggugaugugcgagggcgaggacgacgcccuggaccaggccagccugggcgccgagcccaucagagaccaggcccccggccugagaacccaggccagaagcaccgagagaugguucgccgugaccgagcugaacggccaggccuacgaccccuucggcgaccagcccgccccccugggcgugcccgacuucgaggccagaaucgugggcgcccuggugagacugcccggcaccaaccccaccagcaacagcagauucgaggacgccuggaucgacaccaacaaccagaccaccuacgcccccgccgccggcaugguggccaucaccaccagcgacgacagcagcagcaacuacgccaacgaccaggugugcgaguuccugccccugggcguggacaucaccaacagcacccccuacaacgaguucgaccugcccagcuacggcggcagcgccagcagcggcaacagaaaccuggcccccaccguggcccccaccuuccccggcgagaucgugcugcuguucggcagcaacaugcccgugcagaacagaagcgccggcaccagcaacaaggagaucagaugccugcugcccaacgaguacauccagcaccuguacgacacccaggcccccagccugagcgacguggcccuggugagauacaucaaccccgacaccggcagagugcuguucgaggccaagcugcacagagacggcuucaugaccgugaacgccagcgccaccaccgugcugcccguggacggccacuucagauucgacagcugggugaaccaguucuacgcccugagccccgugggcaacgccagcggcagaagaggcagaaacagaagaguggacuga

SEQ ID NO: 23270 - RNA, 1623 nt, Artificial Sequence; identical to SEQ ID NO: 22671
  derived and/or modified sequence opt4 from VP1__Norovirus__BAS29993

SEQ ID NO: 23271 - RNA, 1623 nt, Artificial Sequence
  derived and/or modified sequence opt4 from VP1__Norovirus__BAS29996
augaagauggccagcaacgacgccacccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23272 - RNA, 1623 nt, Artificial Sequence
  derived and/or modified sequence opt4 from VP1__Norovirus__BAS29999
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagagacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgagguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23273 - RNA, 1623 nt, Artificial Sequence
  derived and/or modified sequence opt4 from VP1__Norovirus__BAS30005
augaagauggccagcaacgacgccaaccccagcgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23274 - RNA, 1623 nt, Artificial Sequence
  derived and/or modified sequence opt4 from VP1__Norovirus__BAS30008
augaagauggccagcaacgacgccaaccccagcgacggcagcgccgccaaccuggugcccgaggugaacaacgaggugauggcccuggagcccguggugggcgccgccaucgccgcccccguggccggccagaccaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgaggcccaccagaacaccaaguucacccccgugggcgugauccaggacggcagcaccacccacagaaacgagccccagcagugggugcugcccagcuacagcggcggcaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23275 - RNA, 1623 nt, Artificial Sequence; identical to SEQ ID NO: 23122
  derived and/or modified sequence opt4 from VP1__Norovirus__BAS30011

SEQ ID NO: 23276 - RNA, 1623 nt, Artificial Sequence
  derived and/or modified sequence opt4 from VP1__Norovirus__BAS30014
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaucuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23277 - RNA, 1623 nt, Artificial Sequence
  derived and/or modified sequence opt4 from VP1__Norovirus__BAS30017
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcaccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucggcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23278 - RNA, 1623 nt, Artificial Sequence
  derived and/or modified sequence opt4 from VP1__Norovirus__BAS30023
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaucgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23279 - RNA, 1623 nt, Artificial Sequence; identical to SEQ ID NO: 23157
  derived and/or modified sequence opt4 from VP1__Norovirus__BAS30026

SEQ ID NO: 23280 - RNA, 1623 nt, Artificial Sequence
  derived and/or modified sequence opt4 from VP1__Norovirus__BAS30029
augaagauggccagcaacgacgccagccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23281 - RNA, 1623 nt, Artificial Sequence
  derived and/or modified sequence opt4 from VP1__Norovirus__BAS30035
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucggcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23282 - RNA, 1623 nt, Artificial Sequence; identical to SEQ ID NO: 23281
  derived and/or modified sequence opt4 from VP1__Norovirus__BAS30038

SEQ ID NO: 23283 - RNA, 1623 nt, Artificial Sequence; identical to SEQ ID NO: 23278
  derived and/or modified sequence opt4 from VP1__Norovirus__BAS30041

SEQ ID NO: 23284 - RNA, 1623 nt, Artificial Sequence
  derived and/or modified sequence opt4 from VP1__Norovirus__BAS30044
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgagccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23285 - RNA, 1623 nt, Artificial Sequence; identical to SEQ ID NO: 23276
  derived and/or modified sequence opt4 from VP1__Norovirus__BAS30047

SEQ ID NO: 23286 - RNA, 1623 nt, Artificial Sequence; identical to SEQ ID NO: 22671
  derived and/or modified sequence opt4 from VP1__Norovirus__BAS30050

SEQ ID NO: 23287 - RNA, 1623 nt, Artificial Sequence
  derived and/or modified sequence opt4 from VP1__Norovirus__BAS30053
augaagauggccagcaacgacgccacccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucaacaccgacaccgagaacgacuucgagacccaccagaacaccaaguucacccccgugggcgugauccaggacggcagcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23288 - RNA, 1623 nt, Artificial Sequence; identical to SEQ ID NO: 23278
  derived and/or modified sequence opt4 from VP1__Norovirus__BAS30056

SEQ ID NO: 23289 - RNA, 1623 nt, Artificial Sequence
  derived and/or modified sequence opt4 from VP1__Norovirus__BAS30059
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccaggacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23290 - RNA, 1623 nt, Artificial Sequence; identical to SEQ ID NO: 23197
  derived and/or modified sequence opt4 from VP1__Norovirus__BAS30062

SEQ ID NO: 23291 - RNA, 1623 nt, Artificial Sequence
  derived and/or modified sequence opt4 from VP1__Norovirus__BAS30065
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccguggugaagaccacccugagcgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23292 - RNA, 1623 nt, Artificial Sequence
  derived and/or modified sequence opt4 from VP1__Norovirus__BAS30068
augaagauggccagcaacgacgccaccgccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaucgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23293 - RNA, 1623 nt, Artificial Sequence; identical to SEQ ID NO: 23278
  derived and/or modified sequence opt4 from VP1__Norovirus__BAS30071

SEQ ID NO: 23294 - RNA, 1623 nt, Artificial Sequence; identical to SEQ ID NO: 23278
  derived and/or modified sequence opt4 from VP1__Norovirus__BAS30074

SEQ ID NO: 23295 - RNA, 1623 nt, Artificial Sequence
  derived and/or modified sequence opt4 from VP1__Norovirus__BAS30077
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagccacaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccgcccacagaaacgagccccagcagugggugcugcccagcuacagcggcagaaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23296 - RNA, 1623 nt, Artificial Sequence
  derived and/or modified sequence opt4 from VP1__Norovirus__BAS30080
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggccagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23297 - RNA, 1623 nt, Artificial Sequence; identical to SEQ ID NO: 22671
  derived and/or modified sequence opt4 from VP1__Norovirus__BAS30083

SEQ ID NO: 23298 - RNA, 1623 nt, Artificial Sequence
  derived and/or modified sequence opt4 from VP1__Norovirus__BAS30086
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccaacagccacaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23299 - RNA, 1623 nt, Artificial Sequence
  derived and/or modified sequence opt4 from VP1__Norovirus__BAS30089
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugagcaucugcaccuucagaggcgacgugacccacaucgccggcagcagagacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccgcccacagaaacgagccccagcagugggugcugcccagcuacagcggcagaaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23300 - RNA, 1623 nt, Artificial Sequence
  derived and/or modified sequence opt4 from VP1__Norovirus__BAS30092
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaucgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccagcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23301 - RNA, 1623 nt, Artificial Sequence
  derived and/or modified sequence opt4 from VP1__Norovirus__BAS30095
augaagauggccagcaacgacgccaaccccuucgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccgccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23302 - RNA, 1623 nt, Artificial Sequence
  derived and/or modified sequence opt4 from VP1__Norovirus__BAS30098
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucaucgugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23303 - RNA, 1623 nt, Artificial Sequence
  derived and/or modified sequence opt4 from VP1__Norovirus__BAS30101
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccgcccacagaaacgagccccagcagugggugcugcccagcuacagcggcagaaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23304 - RNA, 1623 nt, Artificial Sequence
  derived and/or modified sequence opt4 from VP1__Norovirus__BAS30104
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagagacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacgccaaguucacccccgugggcgugauccaggacggcagcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23305 - RNA, 1623 nt, Artificial Sequence
  derived and/or modified sequence opt4 from VP1__Norovirus__BAS30107
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagccacaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23306 - RNA, 1623 nt, Artificial Sequence; identical to SEQ ID NO: 23278
  derived and/or modified sequence opt4 from VP1__Norovirus__BAS30110

SEQ ID NO: 23307 - RNA, 1623 nt, Artificial Sequence; identical to SEQ ID NO: 22671
  derived and/or modified sequence opt4 from VP1__Norovirus__BAS30113

SEQ ID NO: 23308 - RNA, 1623 nt, Artificial Sequence
  derived and/or modified sequence opt4 from VP1__Norovirus__BAS30116
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagagacuacaccaugaaccuggccagccugaacuggaacaacuacgaccccaccgaggagauccccgccccccugggcacccccgacuucgugggcaagauccagggcaugcugacccagaccaccaagggcgacggcagcaccagaggccacaaggccaccguguacaccggcagcgcccccuucacccccaagcugggcagcgugagauucagcaccgacaccgagaacgacuucgagauccaccagaacaccaaguucacccccgugggcgugauccaggacggcagcaccacccacagaaacgagccccagcagugggugcugcccagcuacagcggcagagacgcccacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23309 - RNA, 1623 nt, Artificial Sequence; identical to SEQ ID NO: 23278
  derived and/or modified sequence opt4 from VP1__Norovirus__BAS30119

SEQ ID NO: 23310 - RNA, 1623 nt, Artificial Sequence
  derived and/or modified sequence opt4 from VP1__Norovirus__BAS30125
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagagacuacaccaugaaccuggccagccugaacuggaacaacuacgaccccaccgaggagauccccgccccccugggcacccccgacuucgugggcaagauccagggcaugcugacccagaccaccaagggcgacggcagcaccagaggccacaaggccaccguguacaccggcagcgcccccuucacccccaagcugggcagcgugagauucagcaccgacaccgagaacgacuucgagauccaccagaacaccaaguucacccccgugggcgugauccaggacggcagcaccacccacagaaacgagccccagcagugggugcugcccagcuacagcggcagagacgcccacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagugcuguga

SEQ ID NO: 23311 - RNA, 1623 nt, Artificial Sequence; identical to SEQ ID NO: 22671
  derived and/or modified sequence opt4 from VP1__Norovirus__BAS30128

SEQ ID NO: 23312 - RNA, 1623 nt, Artificial Sequence
  derived and/or modified sequence opt4 from VP1__Norovirus__BAS30134
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcaugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagagacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23313 - RNA, 1623 nt, Artificial Sequence; identical to SEQ ID NO: 22671
  derived and/or modified sequence opt4 from VP1__Norovirus__BAS30137

SEQ ID NO: 23314 - RNA, 1623 nt, Artificial Sequence; identical to SEQ ID NO: 22671
  derived and/or modified sequence opt4 from VP1__Norovirus__BAS30140

SEQ ID NO: 23315 - RNA, 1623 nt, Artificial Sequence
  derived and/or modified sequence opt4 from VP1__Norovirus__BAS30146
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaucgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagccacaacuacaccaugagccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23316 - RNA, 1623 nt, Artificial Sequence
  derived and/or modified sequence opt4 from VP1__Norovirus__BAS30149
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23317 - RNA, 1623 nt, Artificial Sequence; identical to SEQ ID NO: 22671
  derived and/or modified sequence opt4 from VP1__Norovirus__BAS30152

SEQ ID NO: 23318 - RNA, 1623 nt, Artificial Sequence
  derived and/or modified sequence opt4 from VP1__Norovirus__BAS30155
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucaagggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccaccagaacgagccccagcagugggugcugcccagcuacagcggcagagacgugcccaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23319 - RNA, 1623 nt, Artificial Sequence
  derived and/or modified sequence opt4 from VP1__Norovirus__BAS30158
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaucgagggccugagccccagccaggugaccauguucccccacaucaucguggacgugagacagcuggagcccgugcugaucccccugcccgacgugagaaacaacuucuaccacuacaaccagcugaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugagccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23320 - RNA, 1623 nt, Artificial Sequence
  derived and/or modified sequence opt4 from VP1__Norovirus__BAS30164
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaucgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugagccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23321 - RNA, 1623 nt, Artificial Sequence; identical to SEQ ID NO: 23316
  derived and/or modified sequence opt4 from VP1__Norovirus__BAS30167

SEQ ID NO: 23322 - RNA, 1623 nt, Artificial Sequence; identical to SEQ ID NO: 22671
  derived and/or modified sequence opt4 from VP1__Norovirus__BAS30170

SEQ ID NO: 23323 - RNA, 1623 nt, Artificial Sequence
  derived and/or modified sequence opt4 from VP1__Norovirus__BAS30173
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccaguacgaccuggugaucccccccaacggcuacuucagauucgacagcugggugaaccaguucuacacccuggcccccaugggcaacggcaccggcagaagaagagcccuguga

SEQ ID NO: 23324 - RNA, 1623 nt, Artificial Sequence
  derived and/or modified sequence opt4 from VP1__Norovirus__BAS30176
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagacccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcaugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23325 - RNA, 1623 nt, Artificial Sequence
  derived and/or modified sequence opt4 from VP1__Norovirus__BAS30179
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggccugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcaugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23326 - RNA, 1623 nt, Artificial Sequence
  derived and/or modified sequence opt4 from VP1__Norovirus__BAS30182
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagagacuacaccaugaaccuggccagccugaacuggaacaacuacgaccccaccgaggagauccccgccccccugggcacccccgacuucgugggcaagauccagggcaugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23327 - RNA, 1623 nt, Artificial Sequence
  derived and/or modified sequence opt4 from VP1__Norovirus__BAS30185
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcaugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23328 - RNA, 1623 nt, Artificial Sequence
  derived and/or modified sequence opt4 from VP1__Norovirus__BAS30188
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcaugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccacgacggcagcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23329 - RNA, 1623 nt, Artificial Sequence; identical to SEQ ID NO: 23281
  derived and/or modified sequence opt4 from VP1__Norovirus__BAS30191

SEQ ID NO: 23330 - RNA, 1623 nt, Artificial Sequence; identical to SEQ ID NO: 23281
  derived and/or modified sequence opt4 from VP1__Norovirus__BAS30194

SEQ ID NO: 23331 - RNA, 1623 nt, Artificial Sequence; identical to SEQ ID NO: 23281
  derived and/or modified sequence opt4 from VP1__Norovirus__BAS30197

SEQ ID NO: 23332 - RNA, 1623 nt, Artificial Sequence; identical to SEQ ID NO: 23281
  derived and/or modified sequence opt4 from VP1__Norovirus__BAS30200

SEQ ID NO: 23333 - RNA, 1623 nt, Artificial Sequence; identical to SEQ ID NO: 23281
  derived and/or modified sequence opt4 from VP1__Norovirus__BAS30203

SEQ ID NO: 23334 - RNA, 1623 nt, Artificial Sequence; identical to SEQ ID NO: 23281
  derived and/or modified sequence opt4 from VP1__Norovirus__BAS30206

SEQ ID NO: 23335 - RNA, 1623 nt, Artificial Sequence
  derived and/or modified sequence opt4 from VP1__Norovirus__BAS30209
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggaggugcccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagagacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23336 - RNA, 1623 nt, Artificial Sequence
  derived and/or modified sequence opt4 from VP1__Norovirus__BAS30212
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagagacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23337 - RNA, 1623 nt, Artificial Sequence
  derived and/or modified sequence opt4 from VP1__Norovirus__BAS30215
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcaugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23338 - RNA, 1623 nt, Artificial Sequence; identical to SEQ ID NO: 23337
  derived and/or modified sequence opt4 from VP1__Norovirus__BAS30218

SEQ ID NO: 23339 - RNA, 1623 nt, Artificial Sequence
  derived and/or modified sequence opt4 from VP1__Norovirus__BAS30221
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaaggugcagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23340 - RNA, 1623 nt, Artificial Sequence
  derived and/or modified sequence opt4 from VP1__Norovirus__BAS30224
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcaugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23341 - RNA, 1623 nt, Artificial Sequence
  derived and/or modified sequence opt4 from VP1__Norovirus__BAS30227
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagagccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccccaacuggaacaacuacgaccccaccgaggagauccccgccccccugggcacccccgacuucgugggcaagauccagggcaugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23342 - RNA, 1623 nt, Artificial Sequence
  derived and/or modified sequence opt4 from VP1__Norovirus__BAS30230
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacagcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccagcagcagaaacuacaccaugaaccuggccagccugaacuggaacaacuacgaccccaccgaggagauccccgccccccugggcacccccgacuucgugggcaagauccagggcaugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcccaacgugcaccuggcccccgccguggcccccgccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23343 - RNA, 1623 nt, Artificial Sequence; identical to SEQ ID NO: 22671
  derived and/or modified sequence opt4 from VP1__Norovirus__BAS30233

SEQ ID NO: 23344 - RNA, 1623 nt, Artificial Sequence; identical to SEQ ID NO: 23337
  derived and/or modified sequence opt4 from VP1__Norovirus__BAS30236

SEQ ID NO: 23345 - RNA, 1623 nt, Artificial Sequence; identical to SEQ ID NO: 23337
  derived and/or modified sequence opt4 from VP1__Norovirus__BAS30239

SEQ ID NO: 23346 - RNA, 1623 nt, Artificial Sequence
  derived and/or modified sequence opt4 from VP1__Norovirus__BAS30242
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggaggugcccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagagacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23347 - RNA, 1620 nt, Artificial Sequence
  derived and/or modified sequence opt4 from VP1__Norovirus__BAS30245
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccaucccccccaacuuccccaccgagggccugagccccagccaggugaccauguucccccacaucgugguggacgugagacagcuggagcccgugcugaucccccugcccgacgugagaaacaacuucuaccacuacaaccagaccaaggagagcaccaucaagcugguggccaugcuguacaccccccugagagccaacaacgccggcgacgacguguucaccgugagcugcagagugcugaccagacccagccccgacuucgacuucaucuuccuggugccccccagcguggagagcagaaccaagcccuucaccgugcccauccugaccguggaggagaugaccaacagcagauuccccaucccccuggagagacuguucaccggccccagcagcgccuucguggugcagccccagaacggcagaugcaccaccgacggcgugcugcugggcaccacccagcugagccccgugaacaucugcaccuucagaggcgacgugaccagagugagcaccacccacguguacgagaugaaccuggccagccagaacuggaacaacuacgaccccaccgaggaggugcccgccccccugggcacccccgacuucgugggcaagauccagggcgugcugacccagaccaccagaaccgacggcagcaccagagcccacaaggccaccgugagcaccggcgccgccgacuucacccccaagcugggcagcaucagauucgagaccaccaccaacagagaccuggagacccaccagaacaccaaguucacccccgugggcgugauccaggacggcgacaaccaccagaacgagccccagcaguggagacugcccggcuacgccggcagagacgcccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuaccugaccguggcccacaccggccccuacgaccuggugaucccccccaacggcuacuucagauucgacagcugggugaaccaguucuacacccuggcccccaugggcaacggcaccggcagaagaagagcccuguga

SEQ ID NO: 23348 - RNA, 1623 nt, Artificial Sequence
  derived and/or modified sequence opt4 from VP1__Norovirus__BAS30248
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccacccagaacuggaacagcuacgaccccaccgaggagauccccgccccccugggcacccccgacuucgugggcaagauccagggcgugcugacccagaccaccagagccgacggcagcaccagaggccacaaggccaucguguacaccggcagcgccgacuucgcccccaagcugggcagagugcaguucgccaccgacaccgacaacgacuucggcgccaaccagaacaccaaguucacccccgugggcgugauccaggacggcgacaccgcccacagaaacgagccccagcagugggugcugcccagcuacagcggcagaaacagccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23349 - RNA, 1623 nt, Artificial Sequence; identical to SEQ ID NO: 22612
  derived and/or modified sequence opt4 from VP1__Norovirus__BAS30251

SEQ ID NO: 23350 - RNA, 1626 nt, Artificial Sequence
  derived and/or modified sequence opt4 from VP1__Norovirus__BAS30254
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcaaggugagccccaucccccugaagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23351 - RNA, 1623 nt, Artificial Sequence; identical to SEQ ID NO: 22635
  derived and/or modified sequence opt4 from VP1__Norovirus__BAS30257

SEQ ID NO: 23352 - RNA, 1623 nt, Artificial Sequence; identical to SEQ ID NO: 22112
  derived and/or modified sequence opt4 from VP1__Norovirus__BAS30260

SEQ ID NO: 23353 - RNA, 1623 nt, Artificial Sequence
  derived and/or modified sequence opt4 from VP1__Norovirus__BAS30263
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcgagaccaagcccuucuucuuccccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23354 - RNA, 1623 nt, Artificial Sequence; identical to SEQ ID NO: 22635
  derived and/or modified sequence opt4 from VP1__Norovirus__BAS30266

SEQ ID NO: 23355 - RNA, 1623 nt, Artificial Sequence; identical to SEQ ID NO: 22635
  derived and/or modified sequence opt4 from VP1__Norovirus__BAS30269

SEQ ID NO: 23356 - RNA, 1623 nt, Artificial Sequence; identical to SEQ ID NO: 22635
  derived and/or modified sequence opt4 from VP1__Norovirus__BAS30272

SEQ ID NO: 23357 - RNA, 1623 nt, Artificial Sequence
  derived and/or modified sequence opt4 from VP1__Norovirus__BAS30275
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccuguucccccuggccagaaaggugaagggcuacgccggcggcuucgaggugcaggugauccuggccggcaaggccuuccccgccggcaagaucaucuucgccgccagcccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcaccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccagaacuggaacagcuacgaccccaccgaggagauccccgccccccugggcacccccgacuucgugggcaagauccagggcgugcugacccagaccaccagaagagacggcagcaccagaggccacaaggccaccguguacaccggcagcgccgacuucagccccaagcugggcagagugcaguucgccaccgacaccgacaacgacuucgacacccaccagaacaccaaguucacccccgugggcgugauccaggacggcggcaccgcccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23358 - RNA, 1623 nt, Artificial Sequence; identical to SEQ ID NO: 22635
  derived and/or modified sequence opt4 from VP1__Norovirus__BAS30278

SEQ ID NO: 23359 - RNA, 1623 nt, Artificial Sequence; identical to SEQ ID NO: 22108
  derived and/or modified sequence opt4 from VP1__Norovirus__BAS30284

SEQ ID NO: 23360 - RNA, 1623 nt, Artificial Sequence
  derived and/or modified sequence opt4 from VP1__Norovirus__BAS30287
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcuggaucaaccaguucuacacccuggcccccaugggcaacggcaccggcagaagaagagcccuguga

SEQ ID NO: 23361 - RNA, 1623 nt, Artificial Sequence
  derived and/or modified sequence opt4 from VP1__Norovirus__BAS30290
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaagcauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23362 - RNA, 1623 nt, Artificial Sequence
  derived and/or modified sequence opt4 from VP1__Norovirus__BAS30293
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcaccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgacgccaaccagaacaccaaguucacccccgugggcgugauccaggacggcggcaccgcccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgccaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23363 - RNA, 1623 nt, Artificial Sequence
  derived and/or modified sequence opt4 from VP1__Norovirus__BAS30296
augaagauggccagcaaccacgugaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaucaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23364 - RNA, 1623 nt, Artificial Sequence; identical to SEQ ID NO: 22613
  derived and/or modified sequence opt4 from VP1__Norovirus__BAS30299

SEQ ID NO: 23365 - RNA, 1623 nt, Artificial Sequence
  derived and/or modified sequence opt4 from VP1__Norovirus__BAS30302
augaagauggccagcagcgacgccaaccccuucgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccugagcagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23366 - RNA, 1623 nt, Artificial Sequence
  derived and/or modified sequence opt4 from VP1__Norovirus__BAS30305
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcggcacccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23367 - RNA, 1626 nt, Artificial Sequence
  derived and/or modified sequence opt4 from VP1__Norovirus__BAS30308
augaagauggccagcaacgacgugaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccguggugagaaucaucuucagcgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23368 - RNA, 1623 nt, Artificial Sequence; identical to SEQ ID NO: 22072
  derived and/or modified sequence opt4 from VP1__Norovirus__BAS30311

SEQ ID NO: 23369 - RNA, 1623 nt, Artificial Sequence
  derived and/or modified sequence opt4 from VP1__Norovirus__BAS30314
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaacaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23370 - RNA, 1623 nt, Artificial Sequence
  derived and/or modified sequence opt4 from VP1__Norovirus__BAS30317
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcaccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgacgccaaccagaacaccaaguucacccccgugggcgugauccaggacggcggcaccgcccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23371 - RNA, 1623 nt, Artificial Sequence; identical to SEQ ID NO: 23370
  derived and/or modified sequence opt4 from VP1__Norovirus__BAS30320

SEQ ID NO: 23372 - RNA, 1623 nt, Artificial Sequence
  derived and/or modified sequence opt4 from VP1__Norovirus__BAS30323
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcggcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23373 - RNA, 1623 nt, Artificial Sequence
  derived and/or modified sequence opt4 from VP1__Norovirus__BAS30326
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucagcgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcaccuucguggugcagccccagaacggcagaugcaccaccgacggcgugcugcugggcaccacccagcugagccccgugaacaucugcaccuucagaggcgacgugacccacaucaccggcagccacaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgaguucagccccaagcugggcagagugcaguucgccaccgacaccaacaacgacuucgacgccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23374 - RNA, 1623 nt, Artificial Sequence; identical to SEQ ID NO: 22635
  derived and/or modified sequence opt4 from VP1__Norovirus__BAS30329

SEQ ID NO: 23375 - RNA, 1623 nt, Artificial Sequence
  derived and/or modified sequence opt4 from VP1__Norovirus__BAS30332
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucagcgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaccccccuggagaagcuguucaccggccccagcagcaccuucguggugcagccccagaacggcagaugcaccaccgacggcgugcugcugggcaccacccagcugagccccgugaacaucugcaccuucagaggcgacgugacccacaucaccggcagccacaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgaguucagccccaagcugggcagagugcagguggccaccgacaccaacaacgacuucgacgccaaccagaacaccaaguucacccccgugggcgugauccaggacggcggcaccacccacagaaacgagccccagcagugggugcugcccagcuacagcggcagaaacgcccacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23376 - RNA, 1623 nt, Artificial Sequence
  derived and/or modified sequence opt4 from VP1__Norovirus__BAS30335
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagccacaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgaguucagccccaagcugggcagagugcaguucgccaccgacaccaacaacgacuucgacgccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23377 - RNA, 1623 nt, Artificial Sequence; identical to SEQ ID NO: 22612
  derived and/or modified sequence opt4 from VP1__Norovirus__BAS30338

SEQ ID NO: 23378 - RNA, 1623 nt, Artificial Sequence; identical to SEQ ID NO: 22112
  derived and/or modified sequence opt4 from VP1__Norovirus__BAS30341

SEQ ID NO: 23379 - RNA, 1623 nt, Artificial Sequence
  derived and/or modified sequence opt4 from VP1__Norovirus__BAS30344
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaucaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23380 - RNA, 1623 nt, Artificial Sequence; identical to SEQ ID NO: 22112
  derived and/or modified sequence opt4 from VP1__Norovirus__BAS30347

SEQ ID NO: 23381 - RNA, 1623 nt, Artificial Sequence; identical to SEQ ID NO: 22112
  derived and/or modified sequence opt4 from VP1__Norovirus__BAS30350

SEQ ID NO: 23382 - RNA, 1623 nt, Artificial Sequence
  derived and/or modified sequence opt4 from VP1__Norovirus__BAS30353
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagcugaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23383 - RNA, 1623 nt, Artificial Sequence
  derived and/or modified sequence opt4 from VP1__Norovirus__BAS30356
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgagccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcggcaccacccacagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23384 - RNA, 1623 nt, Artificial Sequence; identical to SEQ ID NO: 22635
  derived and/or modified sequence opt4 from VP1__Norovirus__BAS30359

SEQ ID NO: 23385 - RNA, 1623 nt, Artificial Sequence; identical to SEQ ID NO: 22112
  derived and/or modified sequence opt4 from VP1__Norovirus__BAS30362

SEQ ID NO: 23386 - RNA, 1623 nt, Artificial Sequence; identical to SEQ ID NO: 22108
  derived and/or modified sequence opt4 from VP1__Norovirus__BAS30365

SEQ ID NO: 23387 - RNA, 1623 nt, Artificial Sequence; identical to SEQ ID NO: 22112
  derived and/or modified sequence opt4 from VP1__Norovirus__BAS30368

SEQ ID NO: 23388 - RNA, 1623 nt, Artificial Sequence; identical to SEQ ID NO: 22112
  derived and/or modified sequence opt4 from VP1__Norovirus__BAS30371

SEQ ID NO: 23389 - RNA, 1623 nt, Artificial Sequence
  derived and/or modified sequence opt4 from VP1__Norovirus__BAS30374
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgaggccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23390 - RNA, 1623 nt, Artificial Sequence
  derived and/or modified sequence opt4 from VP1__Norovirus__BAU16297
augaagauggccagcaacgacgacaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagagacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaacaaguucuacacccuggcccccaugggcaacggcaccggcagaagaagagccguguga

SEQ ID NO: 23391 - RNA, 1623 nt, Artificial Sequence
  derived and/or modified sequence opt4 from VP1__Norovirus__BAU16299
augaagauggccagcaacgacgccgcccccagcaacgacggcgccgccggccuggugcccgagggcaacaacgagacccugccccuggagcccguggccggcgccgccaucgccgcccccgugaccggccagaacaacaucaucgaccccuggaucagaaucaacuucgugcaggcccccaacggcgaguucaccgugagccccagaaacagccccggcgagauccugcugaaccuggagcugggccccgaccugaaccccuaccuggcccaccugagcagaguguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacagcaaccagcccaacagcagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucagccugcccauccugacccugagcgagcugaccaacagcagauuccccgugcccaucgacagccuguucaccgcccacgacaacguguggcaggugcagugccagaacggcagaugcacccuggacggcgagcugcagggcaccacccagcugcugcccaccggcaucugcgccuucagaggcagagugaccgcccagaucaaccagagagacagauggcacaugcagcugcagaaccugaacggcaccaccuacgaccccaccgacgacgugcccgccccccugggcacccccgacuucaagggcgugguguucggcauggugagccagagaaacgugggcaacgacgcccccggcagcaccagagcccagcaggccugggugagcaccuacagcccccaguucgugcccaagcugggcagcgugaaccugagaaucagcgacaacgacgacuuccaguuccagcccaccaaguucacccccgugggcgugaacgacgacgacgacggccaccccuucagacagugggagcugcccaacuacagcggcgagcugacccugaacaugaaccuggccccccccguggcccccaacuuccccggcgagcagcugcuguucuucagaagcuucgugcccugcagcggcggcuacaaccagggcaucaucgacugccugaucccccaggaguggauccagcacuucuaccaggagagcgcccccagccagagcgacguggcccugaucagauacgugaaccccgacaccggcagaacccuguucgaggccaagcugcacagaagcggcuacaucaccguggcccacagcggcgacuacccccugguggugcccgccaacggccacuucagauucgacagcugggugaaccaguucuacagccuggcccccauggagaccggcaacggcagaagaagagcccaguga

SEQ ID NO: 23392 - RNA, 1635 nt, Artificial Sequence
  derived and/or modified sequence opt4 from VP1__Norovirus__BAU16301
augaugauggccagcaaggacgccgcccccagcgccgacggcgccaccggcgccggccagcuggugcccgaggugaacaccgccgaccccauccccaucgaccccguggccggcagcagcaccgcccuggccaccgccggccaggugaaccugaucgaccccuggaucaucaacaacuucgugcaggccccccagggcgaguucaccaucagccccaacaacacccccggcgacgugcuguucgaccugcagcugggcccccaccugaaccccuuccugagccaccugagccagauguacaacggcugggugggcaacaugagagugagaguggugcuggccggcaacgccuucaccgccggcaaggugaucaucugcugcgugccccccggcuuccagagcagaacccugagcaucgcccaggccacccuguucccccacgugaucgccgacgugagaacccuggaccccguggaggugccccuggaggacgugagaaacgugcuguaccacaacaacgacacccagcccaccaugagacugcugugcaugcuguacaccccccugagaaccggcggcgccagcggcggcaccgacagcuucgugguggccggcagagugcugaccugccccggccccgacuucaacuuccuguuccuggugccccccaccguggagcagaagaccagacccuucaccgugcccaacaucccccugaaguaccugagcaacagcagaauccccaaccccaucgagggcaugagccugagccccgaccagacccagaacgugcaguuccagaacggcagaugcaccaucgacggccagccccugggcaccacccccgugagcgugagccagcugugcaaguucagaggcagaaucaccagcggccagaaggugcugaaccugaccgagcuggacggcagccccuucauggccuucgccgcccccgcccccgugggcuuccccgaccugggcagcugcgacuggcacaucgagaugagcaagauccccaacagcagcacccagagcaaccccaucguggugaacagcgugaagcccaacagccagcaguucgugccccaccugagcagcaucacccuggacgacaacgugagcagcggcggcgacuacaucggcaccauccaguggaccagcccccccagcggcagcggcggcgccaacaccaacuucuggaagauccccgacuacggcagcagccuggccgaggccagccagcuggcccccgccguguacccccccggcuucaacgaggugaucguguacuucauggccagcauccccggccccaaccagagcggcagccccaaccuggugcccugccugcugccccaggaguacaucacccacuucaucagcgagcaggcccccauccagggcgaggccgcccugcugcacuacguggaccccgacaccaacagaaaccugggcgaguucaagcuguaccccggcggcuaccugaccugcgugcccaacagcagcagcaccggcccccagcagcugccccuggacggcguguucguguucgccagcugggugagcagauucuaccagcugaagcccgugggcaccgccggccccgccagaggcagacugggcgugagaagauga

SEQ ID NO: 23393 - RNA, 1623 nt, Artificial Sequence
  derived and/or modified sequence opt4 from VP1__Norovirus__BAU16303
augaugauggccagcaaggacgugcccaccagccccgacggcgccagcggcgccggccagcuggugcccgaggugaacaccgccgaccagaucagcauggaccccguggccggcgccagcaccgccguggccaccgccggccaggugaacaugaucgaccccuggaucuucaacaacuucgugcaggccccccagggcgaguucaccaucagccccaacaacacccccggcgacauccuguucgaccugcagcugggcccccaccugaaccccuuccuggcccaccugagccagauguacaacggcugggugggcaacaugagagugagaauccugcuggccggcaacgccuucaccgccggcaagaucaucaucugcugcgugccccccggcuucgacgccagaauccugaccaucgcccaggccacccuguucccccaccugaucgccgacgugagaacccuggagcccguggagcugccccuggaggacgugagaaacgugcuguaccacaacagcagccagccccagcccaccaugagacugguggccaugcuguacaccccccugagaaccggcggcggcagcggcggcaccgacgccuucgugguggccggcagagugcugaccugccccgcccccgacuucagcuuccuguuccuggugccccccagcguggagcagaagaccagaguguucagcgugcccaacaucccccugaaggaccugagcaacagcagagugcccacccugauccagggcauguucgugagccccgacgugaaccagagcgugcaguuccagaacggcagaugccagaucgacggccagcugcagggcaccacccccgugagccugagccagcugugcaagaucagaggcaagaccagcagcaacaccagagugcugaaccugagcgagguggacggcacccccuucgugccccuggagagccccgcccccgugggcuuccccgacaucggcggcugcgacuggcacgugggcuucaccuucgaggccagagaccagggccccagccagaacgugaccuucgccaccaacgacagcagcuucgugcccuaccugggcagcaucagcccccacaacggcgacggcuuccacagcggcgacaucaucggcagccuggacuggaucagcgcccccagcgacggcagcgcccuggacguguggagcauccccaaguacggcagcagccugcccgacgugacccaccuggcccccgccguguucccccccggcuucggcgaggugauccuguacuuccacagcaaguuccccggcagcggccccaccgacaagcugagagugcccugccugaugccccaggaguucaucacccacuucugcgacgagcaggcccccaucgccggcgaggccgcccugcugcacuacguggaccccgacgccggcagaaaccugggcgaguucaagcuguaccccgacggcuucaugaccugcgugcccaacagcaucagcagcggcccccagacccugcccaucaacggcguguucguguucgugagcugggugagcagauucuaccagcugaagcccgugggcaccgccagcauggccagaagacugggccugagaagaaucuga

SEQ ID NO: 23394 - RNA, 1647 nt, Artificial Sequence
  derived and/or modified sequence opt4 from VP1__Norovirus__BAU16305
augaagauggccagcaacgacgccacccccagcaacgacggcgccgccggccuggugcccgagaucaacaacgaggccauggcccuggaccccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgccuucaccgccggcaagaucaucuucgccgccaucccccccaacuucagcaccgacaaccugagcgccgcccagaucaccaugugcccccacgugaucguggacgugagacagcuggagcccgugaaccugcccaugcccgacgugagaaacaacuucuuccacuacaaccagggcagcgacagcagacugagacugaucgccaugcuguacaccccccugagagccaacaacagcggcgacgacguguucaccgugagcugcagagugcugaccagacccagccccgacuucagcuucaacuuccuggugccccccaccguggagagcaagaccaagcccuucacccugcccauccugaccaucagcgagaugagcaacagcagauuccccgugcccaucgacagccugcacaccagccccaccgagaacgugguggugcagugccagaacggcagagugacccuggacggcgagcugaugggcaccacccagcugcugcccagccagaucugcgccuucagaggcgugcugaccagaagcaccagcagagccagcgaccaggccgacaccgccgcccccagacuguucaacuacuacuggcacauccagcuggacaaccugaacggcacccccuacgaccccgccgaggacauccccggcccccugggcacccccgacuucagaggcaagguguucggcguggccagccagagaaaccccgacagcaccaccagagcccacgaggccaagguggacaccaccgccggcagauucacccccaagcugggcagccuggagaucagcaccgagagcgacgacuucgaccagaaccagcccaccagauucacccccgugggcaucggcguggaccacgaggccgacuuccagcaguggagccugcccgacuacagcggccaguucacccacaacaugaaccuggcccccgccguggcccccaacuuccccggcgagcagcugcuguucuucagaagccagcugcccagcagcggcggcagaagcaacggcauccuggacugccuggugccccaggagugggugcagcacuucuaccaggagagcgcccccgcccagacccagguggcccuggugagauacgugaaccccgacaccggcagagugcuguucgaggccaagcugcacaagcugggcuucaugaccaucgccaagaacggcgacagccccaucaucgugccccccgacggcuacuucagauucgagagcugggugaaccccuucuacacccuggcccccaugggcaucggcaacggcagaagaagaauccaguga

SEQ ID NO: 23395 - RNA, 1671 nt, Artificial Sequence
  derived and/or modified sequence opt4 from VP1__Norovirus__BAU16306
augaagauggccagcagcgacgccgcccccagcgccgacggcgccggcaaccuggugcccgagagccagcaggaggugcugccccuggcccccguggccggcgccgcccuggccgcccccguggugggccagaccaacaucaucgaccccuggaucaaggagaacuucgugcaggccccccagggcgaguucaccgugagccccaagaacagccccggcgagauccuggugaaccuggagcugggccccaagcugaaccccuaccuggaccaccugagcagaauguacaacagcuacgccggcggcaucgacgugaugguggugcuggccggcaacgccuucaccgccggcaaggugcugaucgccgccaucccccccaacuuccccguggagggcgugagcgccagccaggccacccaguucccccacgugaucaucgacgugagaacccuggaccccgugagacugccccugcccgacgugagaagcaccuucuuccacuacaccaacgacaccgagcccaagaugagacuggugaucuggcuguacaccccccugagaaccaacggcagcggcgacgacagcuucaccgugagcggcagaauccugaccagacccagccaggacuucgaguucgccuuccugaucccccccaccguggagaccaagaccacccccuucagcgugcccggcuucagcgugcaggagaugagcaacagcagauggcccgccgccaucagcgccaugguggugagaggcaacgagccccagguggugcaguuccagaacggcagagcccaccuggacggcaugcugcugggcaccacccccgugagccccaacuacaucgccagcuacagaggcaucagcaccggcaacagcagaagcgccagccccgaggccgacgagagagccgugggcagcuucgacguguggaucagacugcaggagcccgacggccagcccuacgacaucuucggcaagcagcccgcccccaucggcacccccgacuucaaggccgugaucgugggcuucgccgccagaccccugaccagcggcagcuacgccaacgaggccuacgugaacaccaccgccagcgacuacgcccccgccaccggcaacaugagauucaccgugagaaacggcggcagcggccacaucagcgccaacaaguacugggaguucaagagcuucggcguggagggcgagagacacaccgacauccaguaccaggaguacgagcugcccgacuacagcggccagguggccagcaaccacaaccuggccccccccguggcccccagaaugcccggcgagagccugcugcuguuccagagcaacaugcccgugugggacgacggccacggcgagagcacccccaagaagauccacugccugcugccccaggaguucaucggccacuucuucgacaagcaggcccccagccugggcgacgccgcccugcugagauacgugaaccaggagaccaacagagugcuguucgagugcaagcuguacagagacggcuacaucaccguggccgccagcagcggccugcuggacuucccccuggacggcuucuucagauucgacagcugggugagcagcuucuacauccugagccccgugggcagcggccagggcagaagaggcagagugagauuccaguga

SEQ ID NO: 23396 - RNA, 1626 nt, Artificial Sequence
  derived and/or modified sequence opt4 from VP1__Norovirus__BAU16307
augaugauggccagcaaggacgccacccccagcgccgacggcgccaacggcgccggccagcuggugcccgaggugaacaacgccgagccccugccccuggaccccguggccggcgccagcaccgcccuggccaccgccggccaggugaacaugaucgaccccuggaucuucaacaacuucgugcaggccccccagggcgaguucaccaucagccccaacaacacccccggcgacauccuguucgaccugcagcugggcccccaccugaaccccuuccuggcccaccugagccagauguacaacggcugggugggcaacaugagagugagagugauccuggccggcaacgccuucaccgccggcaaggugaucaucugcugcgugccccccggcuuccagagcagaacccugagcaucgcccaggccacccuguucccccacgugaucgccgacgugagaacccuggagccccuggagaucccccuggaggacgugagaaacacccuguaccacaacaacgacagccagcccaccaugagacugcugugcaugcuguacaccccccugagaaccggcggcggcagcggcggcaccgacgccuucgugguggccggcagagugcugaccugccccagccccgacuucaacuuccuguuccuggugccccccaccguggagcagaagaccagacccuucagcgugcccaacaucccccugcagaaccugagcaacagcagagugcccagccugauccagagcauggugcugagcagcgaccacgcccagaccgugcaguuccagaacggcagaugcaccaccgacggccaccugcugggcaccacccccgugagcagcggccagcugaugaaguucagaggcaaggugacccccggcagcaaggugcugaaccugaccgagcuggacggcagccccuuccuggccuucgagccccccgcccccgccggcuuccccgaccugggcaagugcgacuggcacaucgagaugagccuguaccaggugaacaaccaggacaaccccaucgugcugagagccaucgagcccaacagcagcagcuucgugccccaccugggcagcgugagcuucaaccagaacguggacgccgccggcgacuacgugugcaccauccaguacaccagcccccccagcaacagccacgacgccgacguggacuucuggagcauccccgacuacggcagcaaccuggccgaggccagccagcuggcccccgugguguacccccccggcuucggcgaggccaucguguacuucaugagcagagugcccggcuggaacagaaccaacagacugaaccuggugcccugccugcugccccaggaguucaucggccacuucgugagcgagcaggcccccgccaucggcgaggccgcccugcugcacuacguggaccccgacaccaacagaaaccugggcgaguucaagcuguaccccgagggcuucaucaccugcgugcccaacggcaccggcccccagcagcugccccugaacggcguguucguguucagcagcugggugagcagauucuaccagcugaagcccgugggcaccgccagcagcgccagaggcagacugggcaucagaagauga

SEQ ID NO: 23397 - RNA, 1623 nt, Artificial Sequence; identical to SEQ ID NO: 22723
  derived and/or modified sequence opt4 from VP1__Norovirus__BAU24831

SEQ ID NO: 23398 - RNA, 1623 nt, Artificial Sequence; identical to SEQ ID NO: 22675
  derived and/or modified sequence opt4 from VP1__Norovirus__BAU24834

SEQ ID NO: 23399 - RNA, 1623 nt, Artificial Sequence
  derived and/or modified sequence opt4 from VP1__Norovirus__BAU24837
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgugcccaagcugggcagagugcaguucgagaccgacaccgacagagacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23400 - RNA, 1623 nt, Artificial Sequence
  derived and/or modified sequence opt4 from VP1__Norovirus__BAU24840
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcacccugagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgacagagacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23401 - RNA, 1623 nt, Artificial Sequence; identical to SEQ ID NO: 22675
  derived and/or modified sequence opt4 from VP1__Norovirus__BAU24843

SEQ ID NO: 23402 - RNA, 1623 nt, Artificial Sequence
  derived and/or modified sequence opt4 from VP1__Norovirus__BAU24846
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcaugcugacccagaccaccaagggcgacggcagcaccagaggccacaaggccaccguguacaccggcagcgcccccuucacccccaagcugggcagcgugcaguucgagaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaucaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23403 - RNA, 1623 nt, Artificial Sequence; identical to SEQ ID NO: 22675
  derived and/or modified sequence opt4 from VP1__Norovirus__BAU24849

SEQ ID NO: 23404 - RNA, 1623 nt, Artificial Sequence
  derived and/or modified sequence opt4 from VP1__Norovirus__BAU24852
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgacagagacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagccguguga

SEQ ID NO: 23405 - RNA, 1623 nt, Artificial Sequence; identical to SEQ ID NO: 23402
  derived and/or modified sequence opt4 from VP1__Norovirus__BAU24855

SEQ ID NO: 23406 - RNA, 1623 nt, Artificial Sequence; identical to SEQ ID NO: 22723
  derived and/or modified sequence opt4 from VP1__Norovirus__BAU24858

SEQ ID NO: 23407 - RNA, 1623 nt, Artificial Sequence
  derived and/or modified sequence opt4 from VP1__Norovirus__BAU24861
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcaugcugacccagaccaccaagggcgacggcagcaccagaggccacaaggccaccguguacaccggcagcgcccccuucacccccaagcugggcagcgugcaguucgagaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23408 - RNA, 1623 nt, Artificial Sequence; identical to SEQ ID NO: 22675
  derived and/or modified sequence opt4 from VP1__Norovirus__BAU24864

SEQ ID NO: 23409 - RNA, 1623 nt, Artificial Sequence
  derived and/or modified sequence opt4 from VP1__Norovirus__BAU24867
augaagauggccagcagcgacgccaaccccaccgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23410 - RNA, 1623 nt, Artificial Sequence; identical to SEQ ID NO: 22723
  derived and/or modified sequence opt4 from VP1__Norovirus__BAU24870

SEQ ID NO: 23411 - RNA, 1623 nt, Artificial Sequence; identical to SEQ ID NO: 22675
  derived and/or modified sequence opt4 from VP1__Norovirus__BAU24873

SEQ ID NO: 23412 - RNA, 1623 nt, Artificial Sequence; identical to SEQ ID NO: 22675
  derived and/or modified sequence opt4 from VP1__Norovirus__BAU24876

SEQ ID NO: 23413 - RNA, 1623 nt, Artificial Sequence; identical to SEQ ID NO: 22675
  derived and/or modified sequence opt4 from VP1__Norovirus__BAU24879

SEQ ID NO: 23414 - RNA, 1623 nt, Artificial Sequence
  derived and/or modified sequence opt4 from VP1__Norovirus__BAU24882
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgagaccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23415 - RNA, 1623 nt, Artificial Sequence
  derived and/or modified sequence opt4 from VP1__Norovirus__BAU24885
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagagacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagccguguga

SEQ ID NO: 23416 - RNA, 1623 nt, Artificial Sequence; identical to SEQ ID NO: 22675
  derived and/or modified sequence opt4 from VP1__Norovirus__BAU24888

SEQ ID NO: 23417 - RNA, 1623 nt, Artificial Sequence
  derived and/or modified sequence opt4 from VP1__Norovirus__BAU24891
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcaugcugacccagaccaccaagggcgacggcagcaccagaggccacaaggccaccguguacaccggcagcgcccccuucacccccaagcugggcagcgugcaguucgccaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23418 - RNA, 1623 nt, Artificial Sequence; identical to SEQ ID NO: 22723
  derived and/or modified sequence opt4 from VP1__Norovirus__BAU24894

SEQ ID NO: 23419 - RNA, 1623 nt, Artificial Sequence
  derived and/or modified sequence opt4 from VP1__Norovirus__BAU24897
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgugcccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23420 - RNA, 1623 nt, Artificial Sequence; identical to SEQ ID NO: 22675
  derived and/or modified sequence opt4 from VP1__Norovirus__BAU24900

SEQ ID NO: 23421 - RNA, 1623 nt, Artificial Sequence; identical to SEQ ID NO: 22675
  derived and/or modified sequence opt4 from VP1__Norovirus__BAU24903

SEQ ID NO: 23422 - RNA, 1623 nt, Artificial Sequence; identical to SEQ ID NO: 22963
  derived and/or modified sequence opt4 from VP1__Norovirus__BAU24906

SEQ ID NO: 23423 - RNA, 1623 nt, Artificial Sequence; identical to SEQ ID NO: 22675
  derived and/or modified sequence opt4 from VP1__Norovirus__BAU24909

SEQ ID NO: 23424 - RNA, 1623 nt, Artificial Sequence; identical to SEQ ID NO: 22723
  derived and/or modified sequence opt4 from VP1__Norovirus__BAU24912

SEQ ID NO: 23425 - RNA, 1623 nt, Artificial Sequence
  derived and/or modified sequence opt4 from VP1__Norovirus__BAU24915
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaagcaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccaacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23426 - RNA, 1623 nt, Artificial Sequence; identical to SEQ ID NO: 22675
  derived and/or modified sequence opt4 from VP1__Norovirus__BAU24918

SEQ ID NO: 23427 - RNA, 1623 nt, Artificial Sequence; identical to SEQ ID NO: 22675
  derived and/or modified sequence opt4 from VP1__Norovirus__BAU24921

SEQ ID NO: 23428 - RNA, 1623 nt, Artificial Sequence; identical to SEQ ID NO: 22675
  derived and/or modified sequence opt4 from VP1__Norovirus__BAU24924

SEQ ID NO: 23429 - RNA, 1623 nt, Artificial Sequence
  derived and/or modified sequence opt4 from VP1__Norovirus__BAU24927
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggagcuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23430 - RNA, 1623 nt, Artificial Sequence
  derived and/or modified sequence opt4 from VP1__Norovirus__BAU24930
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagugguguga

SEQ ID NO: 23431 - RNA, 1623 nt, Artificial Sequence; identical to SEQ ID NO: 22635
  derived and/or modified sequence opt4 from VP1__Norovirus__BAU24933

SEQ ID NO: 23432 - RNA, 1623 nt, Artificial Sequence
  derived and/or modified sequence opt4 from VP1__Norovirus__BAU24936
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucggcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagcccggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23433 - RNA, 1623 nt, Artificial Sequence
  derived and/or modified sequence opt4 from VP1__Norovirus__BAU24942
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagacccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgacagagacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23434 - RNA, 1623 nt, Artificial Sequence
  derived and/or modified sequence opt4 from VP1__Norovirus__BAU24945
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagacccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23435 - RNA, 1623 nt, Artificial Sequence
  derived and/or modified sequence opt4 from VP1__Norovirus__BAU24948
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccgcccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23436 - RNA, 1623 nt, Artificial Sequence; identical to SEQ ID NO: 22072
  derived and/or modified sequence opt4 from VP1__Norovirus__BAU24950

SEQ ID NO: 23437 - RNA, 1623 nt, Artificial Sequence; identical to SEQ ID NO: 22997
  derived and/or modified sequence opt4 from VP1__Norovirus__BAU24952

SEQ ID NO: 23438 - RNA, 1623 nt, Artificial Sequence
  derived and/or modified sequence opt4 from VP1__Norovirus__BAU24954
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcgcccccgacuucgugggcaagauccagggcaugcugacccagaccaccagagccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagagugguguga

SEQ ID NO: 23439 - RNA, 1623 nt, Artificial Sequence; identical to SEQ ID NO: 22675
  derived and/or modified sequence opt4 from VP1__Norovirus__BAU24958

SEQ ID NO: 23440 - RNA, 1623 nt, Artificial Sequence
  derived and/or modified sequence opt4 from VP1__Norovirus__BAU24960
augaagauggccagcaacgacgccaaccccagcgacggccccgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcaugcugacccagaccaccaagggcgacggcagcaccagaggccacaaggccaccguguacaccggcagcgcccccuucacccccaagcugggcagcgugcaguucgagaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaucaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23441 - RNA, 1623 nt, Artificial Sequence; identical to SEQ ID NO: 22723
  derived and/or modified sequence opt4 from VP1__Norovirus__BAU24962

SEQ ID NO: 23442 - RNA, 1623 nt, Artificial Sequence; identical to SEQ ID NO: 23402
  derived and/or modified sequence opt4 from VP1__Norovirus__BAU24964

SEQ ID NO: 23443 - RNA, 1623 nt, Artificial Sequence; identical to SEQ ID NO: 23402
  derived and/or modified sequence opt4 from VP1__Norovirus__BAU24966

SEQ ID NO: 23444 - RNA, 1623 nt, Artificial Sequence
  derived and/or modified sequence opt4 from VP1__Norovirus__BAU24968
augaagauggccagcagcgacgccaaccccagcgacggcagcaccgccaaccuggugcccgaggugaacaacgaggugauggcccuggagcccgugaucggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccugagcagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaugaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23445 - RNA, 1623 nt, Artificial Sequence
  derived and/or modified sequence opt4 from VP1__Norovirus__BAU24972
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacaucacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23446 - RNA, 1623 nt, Artificial Sequence
  derived and/or modified sequence opt4 from VP1__Norovirus__BAU24974
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgacagagacuucgaggccaaccagaacaccaaguucacccccgugggcgugauccaggacggcagcaccacccacagaaacgagccccagcagugggugcugcccagcuacagcggcagaaccacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23447 - RNA, 1623 nt, Artificial Sequence; identical to SEQ ID NO: 22731
  derived and/or modified sequence opt4 from VP1__Norovirus__BAU24976

SEQ ID NO: 23448 - RNA, 1623 nt, Artificial Sequence; identical to SEQ ID NO: 22723
  derived and/or modified sequence opt4 from VP1__Norovirus__BAU24978

SEQ ID NO: 23449 - RNA, 1623 nt, Artificial Sequence; identical to SEQ ID NO: 22723
  derived and/or modified sequence opt4 from VP1__Norovirus__BAU24980

SEQ ID NO: 23450 - RNA, 1623 nt, Artificial Sequence
  derived and/or modified sequence opt4 from VP1__Norovirus__BAU24982
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccaacuucgcccccaagcugggcagaauccaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23451 - RNA, 1623 nt, Artificial Sequence; identical to SEQ ID NO: 22723
  derived and/or modified sequence opt4 from VP1__Norovirus__BAU24984

SEQ ID NO: 23452 - RNA, 1623 nt, Artificial Sequence; identical to SEQ ID NO: 22675
  derived and/or modified sequence opt4 from VP1__Norovirus__BAU24986

SEQ ID NO: 23453 - RNA, 1623 nt, Artificial Sequence
  derived and/or modified sequence opt4 from VP1__Norovirus__BAU24988
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcaugcugacccagaccaccaagggcgacggcagcaccagaggccacaaggccaccguguacaccggcagcgcccccuucacccccaagcugggcagcgugcaguucgagaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccgugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23454 - RNA, 1623 nt, Artificial Sequence
  derived and/or modified sequence opt4 from VP1__Norovirus__BAU24990
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagccacaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagccguguga

SEQ ID NO: 23455 - RNA, 1623 nt, Artificial Sequence
  derived and/or modified sequence opt4 from VP1__Norovirus__BAU24992
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgacagagacuucgaggccaaccagaacaccaaguucacccccgugggcgugauccaggacggcagcaccacccacagaaacgagccccagcagugggugcugcccagcuacagcggcagauacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23456 - RNA, 1623 nt, Artificial Sequence; identical to SEQ ID NO: 22729
  derived and/or modified sequence opt4 from VP1__Norovirus__BAU24994

SEQ ID NO: 23457 - RNA, 1623 nt, Artificial Sequence
  derived and/or modified sequence opt4 from VP1__Norovirus__BAU24996
augaagauggccagcagcgacgccaaccccagcgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgacagagacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23458 - RNA, 1623 nt, Artificial Sequence; identical to SEQ ID NO: 22723
  derived and/or modified sequence opt4 from VP1__Norovirus__BAU24998

SEQ ID NO: 23459 - RNA, 1623 nt, Artificial Sequence
  derived and/or modified sequence opt4 from VP1__Norovirus__BAU25002
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23460 - RNA, 1623 nt, Artificial Sequence; identical to SEQ ID NO: 22675
  derived and/or modified sequence opt4 from VP1__Norovirus__BAU25004

SEQ ID NO: 23461 - RNA, 1644 nt, Artificial Sequence
  derived and/or modified sequence opt4 from VP1_protein__Norovirus__ADN84676
augaagauggccagcagcgacgccgcccccagcaccgacggcagcgccggccuggugcccgaggugaacaacgagaccauggcccuggagcccguggugggcgccccccuggccgcccccguggccggccagcacaacaucaucgaccccuggaucaagaugaacuucgugcaggcccccaacggcgaguucaccgugagccccagaaacgcccccggcgagauccugcuggaccuggagcugggccccgaccugaaccccuaccugagccaccuggccagaauguacaacggcuacgccggcggcauggaggugcagguggugcuggccggcaacgccuucaccgccggcaagaucaucuucgccgccgugccccccaacuuccccgccgagaaccugagcgccgcccaggugaccaugugcccccacgugaucguggacgugagacagcuggagcccgugaugcugcccaugcccgacaucagaaacaagcuguuccacuacaaccagguggacgaccccaagcugagacugcuggccuaccuguacaccccccugagagccaacaacgccggcgacgacguguucaccgugagcugcagagugcugaccagacccacccccgacuucgaguucauguuccuggugccccccaccguggagagcaagaccaagcccuucagccugcccaaccugacccuggacgagcugagcaacagcagauuccccgcccccaucgugcagcuguacaccaacccccacgacaaccugguggugcagccccagaacggcagaugcaccaucgacggccugcugcagggcaccacccagcuggugagcugcaacgugugcagcuucagaggcaccaugggcgagggccagcccgccagccacagcgaggacgagaucaugcccauggccaucaacgugcagagagagaucaugcuggagaaccuggacggcagccccuacgaccccaccgacgacauccccgccgugcugggcagccccgacuuccagggcgugauguucggcauccugagccagagaaacaccgacggccagaccagagcccacgaggccaagguggacaccagagccgccagauucgcccccaagcugggcuucgugguggccaccguggagagcaccgacuuccacgccaaccagcccagcagauucacccccgugggccugggcggcgacgccaacagagacuucaaccaguggcagcugcccgccuacggcggcgcccugaccaacaacaccaaccuggccccccccgugaugcccguguaccccggcgagcagcugcuguucuucagaagccagcugcccagcagcggcggcgugguggccggcuggcuggacugccugcugccccaggagugggugcagcacuucuuccaggagagcgccaccagccagagcaacguggcccuggugagauacgugaaccccaccaccggcagagugcuguucgaggccaagcugcacaagcagggcuuccugaccguggccgccagcggcagcuacccccugguggugcccgccgacggcuacuucagauucgagagcugggugaacgaguucuacacccuggcccccaugggcaacggcagcggcagaagaagagccagauga

SEQ ID NO: 23462 - RNA, 1623 nt, Artificial Sequence
  derived and/or modified sequence opt4 from VP1_protein__Norovirus__BAK68870
augaagauggccagcaacgacgccagccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23463 - RNA, 1620 nt, Artificial Sequence
  derived and/or modified sequence opt4 from capsid__Norovirus__AAC54893
augaagauggccagcagcgacgccaaccccagcgacggcagcgccgccaaccuggugcccgaggugaacaacgaggugauggcccuggagcccguggugggcgccgccaucgccgcccccguggccggccagcagaacaucaucgaccccuggaucagaaacaacuucgugcaggcccccggcggcgaguucaccgugagccccagaaacgcccccggcgagauccuguggagcgccccccugggccccgaccugaaccccuaccugagccaccugagcagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagccacgacagcacccugaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaacuucagaggcgacgugacccacaucgugggcagccacgacuacaccaugaaccuggccagccagaacuggagcaacuacgaccccaccgaggagauccccgccccccugggcacccccgacuucgugggcaagauccagggccugcugacccagaccaccagagccgacggcagcaccagagcccacaaggccaccgugagcaccggcagcgugcacuucacccccaagcugggcagcgugcaguucaccaccgacaccaacaacgacuuccagaccggccagaacaccaaguucacccccgugggcgugauccaggacggcgaccaccaccagaacgagccccagcagugggugcugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcugcacuucuaccaggaggccgcccccgcccagagcgacguggcccugcugagauucgugaaccccgacaccggcagagugcuguucgagugcaagcugcacaagagcggcuacaucaccguggcccacaccggccccuucgaccuggugaucccccccaacggcuacuucagauucgacagcugggugaaccaguucuacacccuggcccccaugggcaacggcaccggcagaagaagagcccuguga

SEQ ID NO: 23464 - RNA, 1647 nt, Artificial Sequence
  derived and/or modified sequence opt4 from capsid__Norovirus__AAW30195
augaagauggccagcaacgacgccacccccagcaacgacggcgccgccggccuggugcccgagaucaacaacgaggccauggcccuggaccccguggccggcgccgccaucgccgccccccugaccggccagcagaacaucaucgaccccuggaucaugaacaacuucgugcaggcccccggcggcgagcugaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgccuucaccgccggcaagaucaucuucgccgccaucccccccaacuuccccaucgacaaccugagcgccgcccagaucaccaugugcccccacgugaucguggacgugagacagcuggagcccgugaaccugcccaugcccgacgugagaaacaacuucuuccacuacaaccagggcagcgacaccagacugagacugaucgccaugcuguacaccccccugagagccaacagcagcggcgacgacguguucaccgugagcugcagagugcugaccagacccagccccgacuucagcuucaacuuccuggugccccccaccguggagagcaagaccaagcccuucacccugcccauccugaccaucagcgagaugagcaacagcagauuccccgugcccaucgacagccugcacaccagccccaccgagaacaucguggugcagugccagaacggcagagugacccuggacggcgagcugaugggcaccacccagcugcugcccagccagaucugcgccuucagaggcaugcugaccagaagcaccagcagagccagcgaccaggccgacaccgccgcccccagacuguucaacuaccacuggcacauccagcuggacaaccugaacggcacccccuacgaccccgccgaggacauccccggcccccugggcacccccgacuucagaggcaagguguucggcguggccagccagagaaaccccgacagcaccaccagagcccacgaggccaagguggacaccaccgccggcagauucacccccaagcugggcagccuggagaucagcaccgagagcggcgaccuggaccagaaccagcccaccaaguucacccccgugggcaucggcguggaccacgaggaggacuuccagcaguggagccugcccgacuacagcggccaguucacccacaacaugaaccuggcccccgccguggcccccaacuuccccggcgagcagcugcuguucuucagaagccagcugcccagcagcggcggcagaagcaacggcauccuggacugccuggugccccaggagugggugcagcacuucuaccaggagagcgcccccgcccagacccagguggcccuggugagauacgugaaccccgacaccggcagagugcuguucgaggccaagcugcacaagcugggcuucaugaccaucgccaagaacggcgacagccccaucaccgugccccccaacggcuacuucggcuucgagagcugggugaaccccuucuacacccuggcccccaugggcaccggcaacggcagaagaagaauccaguga

SEQ ID NO: 23465 - RNA, 1647 nt, Artificial Sequence
  derived and/or modified sequence opt4 from capsid__Norovirus__ABD36491
augaagauggccagcaacgacgccgcccccagcaacgacggcgccgccggccuggugcccgagaucaacaacgaggccauggcccuggagcccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgccuucaccgccggcaaggugaucuucgccgccaucccccccaacuuccccaucgacaaccugagcgccgcccagaucaccaugugcccccacgugaucguggacgugagacagcuggagcccaucaaccugcccaugcccgacgugagaaacaacuucuuccacuacaaccagggcagcgacagcagacugagacugaucgccaugcuguacaccccccugagagccaacaacagcggcgacgacguguucaccgugagcugcagagugcugaccagacccagccccgacuucagcuucaacuuccuggugccccccaccguggagagcaagaccaagcccuucacccugcccauccugaccaucagcgagaugagcaacagcagauuccccgugcccaucgacagccugcacaccagccccaccgagaacaucguggugcagugccagaacggcagagugacccuggacggcgagcugaugggcaccacccagcugcugcccagccagaucugcgccuucagaggcacccugaccagaagcaccagcagagccagcgaccaggccgacaccgccacccccagacuguucaacuacuacuggcacauccagcuggacaaccugaacggcacccccuacgaccccgccgaggacauccccgccccccugggcacccccgacuucagaggcaagguguucggcguggccagccagagaaaccccgacagcaccaccagagcccacgaggccaagguggacaccaccagcggcagauucgcccccaagcugggcagccuggagaucagcaccgagagcagcgacuucgacagcaaccagcccaccagauucacccccgugggcaucggcguggacaacgaggccgacuuccagcaguggagccugcccgacuacagcggccaguucacccacaacaugaaccuggcccccgccguggcccccaacuuccccggcgagcagcugcuguucuucagaagccagcugcccagcagcggcggcagaagcaacggcauccuggacugccuggugccccaggagugggugcagcacuucuaccaggagagcgcccccgcccagacccagguggcccuggugagauacgugaaccccgacaccggcagagugcuguucgaggccaagcugcacaagcugggcuucaugaccaucgccaagaacggcgacagccccaucaccgugccccccaacggcuacuucagauucgagagcugggugaaccccuucuacacccuggcccccaugggcaccggcaacggcagaagaagaauccaguga

SEQ ID NO: 23466 - RNA, 1629 nt, Artificial Sequence
  derived and/or modified sequence opt4 from capsid__Norovirus__ABD36494
augaagauggccagcaacgacgccgcccccagcaacgacggcgccgccagccuggugcccgagggcaucaacgagaccaugccccuggagcccguggccggcgccagcaucgccgcccccguggccggccagaccaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccaucccccccaacuuccccguggacaugaucagccccgcccagaucaccaugcugccccaccugaucguggacgugagaacccuggagcccaucaugaucccccugcccgacgugagaaacguguucuaccacuucaacaaccagccccagcccagaaugagacugguggccaugcuguacaccccccugagaagcaacggcagcggcgacgacguguucaccgugagcugcagagugcugaccagacccacccccgacuucgaguucaucuaccuggugccccccagcguggagagcaagaccaagcccuucacccugcccauccugaccaucagcgagcugaccaacagcagauuccccauccccaucgagcagcuguacaccgcccccaacgagaacaacguggugcagugccagaacggcagaugcacccuggacggcgagcugcagggcaccacccagcugcugagcagcgccaucugcagcuacagaggcagaaccguggccaacaacggcgacaacugggaccagaaccugcugcagcugaccuaccccaacggcgccagcuacgaccccaccgacgaggugcccgccccccugggcacccaggacuucagcggcaugcuguacggcgugcugacccaggacaacaccaacgugagcgccggcgaggccaagaacgccaagggcaucuacaucagcaccaccagcggcaaguucacccccaagaucggcagcaucggccugcacagcaucaccgagcacguguaccccaaccagcagagcagauucacccccgugggcguggccgugaacgagaacacccccuuccagcagugggugcugccccacuacgccggcagccuggcccugaacaccaaccuggcccccgccguggcccccaccuuccccggcgagcagcugcuguucuucagaagcagagugcccugcgugcagggccagcagggccaggacguguucaucgacugccugcugccccaggagugggugaaccacuucuaccaggaggccgcccccagccaggccgacguggcccugaucagauacgugaaccccgacaccggcagaacccuguucgaggccaagcugcacagaagcggcuucaucaccgugagccacaccggcgccuacccccugguggugccccccaacggccacuucagauucgacagcugggugaaccaguucuacagccuggcccccaugggcaccggcaacggcagaagaagaauccaguga

SEQ ID NO: 23467 - RNA, 1614 nt, Artificial Sequence
  derived and/or modified sequence opt4 from capsid__Norovirus__ABD36497
augaagauggccagcaacgacgccgcccccagcagcgacggcgccgccggccuggugcccgagaucaaccacgaggugauggccaucgagcccguggccggcgccagcaucgccgcccccguggugggccagcagaacaucaucgaccccuggaucagaaacaacuucgugcaggcccccgccggcgaguucaccgugagccccagaaacgcccccggcgaguuccugcuggaccuggagcugggccccgaccugaaccccuaccuggcccaccuggccagaauguacaacggccacgccggcggcauggaggugcagaucgugcuggccggcaacgccuucaccgccggcaagauccuguucgccgugaucccccccggcuuccccuacgagaaccugagccccgcccagcugaccaugugcccccacguggugguggacgugagacagcuggagcccgugaugcugcccaugcccgacaucagaaacaccuucuuccacuacaaccaggacggcggccccagacugagacugaucgccaugcuguacaccccccugagagccaacaacagcggcgacgacguguucaccgugagcugcagagugcugaccagacccgcccccgacuucgaguucaccuuccuggugccccccagcguggagagcaagaccaaggccuucaccauccccgugcugaagaucagcgagaugaccaacagcagauuccccgugcccguggaccagauguacaccagcagaagcgagggcaucguggugcagccccagaacggcagagccaccaucgacggcgagcugcugggcaccacccuggugagccccgugagcgugugcaacuucaagggcaaccugcagaccgaggugcccggccagcaccagcaguaccagcugcagcugaccaaccuggacggcagccccaucgaccccaccgacgacacccccggcccccugggcugccccgacuucaucggccugcuguacggcguggccagccagagaggccccggcgacgccaccagagcccacgaggccagaaucgacaccggcagcgacaccuacgcccccaagaucggccaggugagauucuacagcaccagcaacaacuucgagaccaaccagcccacccacuucacccccgugggcguguacaucgagggcagcagcagcgacuucaaccaguggcagcugcccagauacggcggccaccuggccaacaacaaccaccuggcccccgccgugagcccccuguuccccggcgagcagauccuguucuucagaagcuucauccccggcgccagcggccacaccaacggcgagauggacugccugcugccccaggaguucgugcagcacuucuaccaggaggccgccaccgcccagagcgagguggcccugcugagauucgugaaccccgacaccggcagagugcuguucgagagcaagcugcacaagcagggcuucaugaccaucgccagcagcggcgaccaccccaucaucaugcccaccaacggcuacuucagauucgaggccugggugaaccaguucuacagccuggcccccgugggcaccggcagcggcagaagaagaauccaguga

SEQ ID NO: 23468 - RNA, 1623 nt, Artificial Sequence
  derived and/or modified sequence opt4 from capsid__Norovirus__ABL74387
augaagauggccagcaacgacgccacccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccagaacuacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcgugcacuucacccccaagcugggcagcgugcaguucagcaccgacaccagcaacgacuucgaggccggccagaacaccagauucacccccgugggcguggugcaggacggcagcaccacccaccagaacgagccccagcagugggugcugcccgacuacagcggcagagacagccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggagagcgcccccgcccagagcgacguggcccugcugagauucgugaaccccgacaccggcagagugcuguucgagugcaagcugcacaagagcggcuacgugaccguggccuacaccggccagcacgaccuggugaucccccccaacggcuacuucagauucgacagcugggugaaccaguucuacacccuggcccccaugggcaacggcgccggcagaagaagagcccuguga

SEQ ID NO: 23469 - RNA, 1623 nt, Artificial Sequence
  derived and/or modified sequence opt4 from capsid__Norovirus__ABL74389
augaagauggccagcaacgacgccacccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucagacugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccagaacuacaccaugaaccuggccagccagaacuggaacaacuacgaccccaccgaggaggugcccgccccccugggcacccccgacuucgugggcaagauccagggcgugcugacccagaccaccagaggcgacggcagcaccagaggccacaaggccaccgugagcaccggcagcgugcacuucacccccaagcugggcagcgugcaguucagcaccgacaccagcaacgacuucgagaccggccagaacaccagauucacccccgugggcguggugcaggacggcagcaccacccaccagaacgagccccagcagugggugcugcccgacuacagcggcagagacaaccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggagagcgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagagcccuguga

SEQ ID NO: 23470 - RNA, 1623 nt, Artificial Sequence; identical to SEQ ID NO: 22522
  derived and/or modified sequence opt4 from capsid__Norovirus__ABL74397

SEQ ID NO: 23471 - RNA, 1593 nt, Artificial Sequence
  derived and/or modified sequence opt4 from capsid__Norovirus__ABQ44562
augaugauggccagcaaggacgccaccagcagcguggacggcgccagcggcgccggccagcuggugcccgaggugaacgccagcgacccccuggccauggaccccguggccggcagcagcaccgccguggccaccgccggccaggugaaccccaucgaccccuggaucaucaacaacuucgugcaggccccccagggcgaguucaccaucagccccaacaacacccccggcgacgugcuguucgaccugagccugggcccccaccugaaccccuuccugcugcaccugagccagauguacaacggcugggugggcaacaugagagugagaaucaugcuggccggcaacgccuucaccgccggcaagaucaucgugagcugcaucccccccggcuucggcagccacaaccugaccaucgcccaggccacccuguucccccacgugaucgccgacgugagaacccuggaccccaucgaggugccccuggaggacgugagaaacgugcuguuccacaacaacgacagaaaccagcagaccaugagacuggugugcaugcuguacaccccccugagaaccggcggcggcaccggcgacagcuucgugguggccggcagagugaugaccugccccagccccgacuucaacuuccuguuccuggugccccccaccguggagcagaagaccagacccuucacccugcccaaccugccccugagcagccugagcaacagcagagccccccugcccaucagcggcaugggcaucagccccgacaacgugcagagcgugcaguuccagaacggcagaugcacccuggacggcagacuggugggcaccacccccgugagccugagccacguggccaagaucagaggcaccagcaacggcaccgugaucaaccugaccgagcuggacggcacccccuuccaccccuucgagggccccgcccccaucggcuuccccgaccugggcggcugcgacuggcacaucaacaugacccaguucggccacagcagccagacccaguacgacguggacaccacccccgacaccuucgugccccaccugggcagcauccaggccaacggcgugagcagcggcaacuacaucggcgugcugagcugggugagcccccccagccaccccagcggcagccagguggaccuguggaagauccccaacuacggcagcagcaucaccgaggccacccaccuggcccccagcguguacccccccggcuucggcgaggugcugguguucuucaugagcaagauccccggccccggcgccuacagccugcccugccugcugccccaggaguacaucagccaccuggccagcgagcaggcccccaccgugggcgaggccgcccugcugcacuacguggaccccgacaccggcagaaaccugggcgaguucaaggccuaccccgacggcuuccugaccugcgugcccaacggcgccagcagcggcccccagcagcugcccaucaacggcguguucguguucgugagcugggugagcagauucuaccagcugaagcccgugggcaccgccagcaccgccagaggcagacugggccugagaagauga

SEQ ID NO: 23472 - RNA, 1638 nt, Artificial Sequence
  derived and/or modified sequence opt4 from capsid__Norovirus__ABQ44563
augaugauggccagcaagggcgcccccaccaacauggacggcaccagcggcgccggccagcuggugcccgaggccaacaccgccgagcccaucagcauggagcccguggccggcgccgccaccgccgccgccaccgccggccaggugaacaugaucgaccccuggaucaugaacaacuacgugcaggccccccagggcgaguucaccaucagccccaacaacacccccggcgacauccuguucgaccugcagcugggcccccaccugaaccccuuccugagccaccuggcccagauguacaacggcugggugggcaacaugaaggugaaggugcugcuggccggcaacgccuucaccgccggcaagaucaucaucagcugcaucccccccggcuucguggcccagaacaucagcaucgcccaggccaccauguucccccacgugaucgccgacgugagagugcuggagcccaucgaggugccccuggaggacgugagaaacgugcuguuccacaacaacgacaacacccccaccaugagacuggugugcaugcuguacaccccccugagagccagcggcagcagcagcggcaccgaccccuucgugaucgccggcagagugcugaccugccccagccccgacuucagcuuccuguuccuggugccccccaacguggagcagaagaccaagcccuucagcgugcccaaccugccccugaacacccugagcaacagcagagugcccagccugaucaagagcaugauggugagcagagaccacggccagauggugcaguuccagaacggcagagugacccuggacggccagcugcagggcaccacccccaccagcgccagccagcugugcaagaucagaggcagcguguuccacgccaacggcggcaacggcuacaaccugaccgagcuggacggcagccccuaccacgccuucgagagccccgcccccaucggcuuccccgaccugggcgagugcgacuggcacauggaggccagccccaccacccaguucaacaccggcgacgugaucaagcagaucaacgugaagcaggagagcgccuucgccccccaccugggcaccauccaggccgacggccugagcgacgugagcgugaacaccaacaugaucgccaagcuggagugggugagccccgugagcgacggccacaagggcgacguggaccccugggugauccccagauacggcagcacccugaccgaggccgcccagcuggccccccccaucuacccccccggcuucggcgaggccaucguguucuucaugagcgacuuccccaucgcccacggcaccaacggccugagcgugcccugcaccaucccccaggaguucgugacccacuucgugaacgagcaggcccccaccagaggcgaggccgcccugcugcacuaccuggaccccgacacccacagaaaccugggcgaguucaagcuguaccccgacggcuucaugaccugcgugcccaacagcagcggcaccggcccccagacccugcccaucaacggcguguucguguucgugagcugggugagcagauucuaccagcugaagcccgugggcaccgccggccccgccagaagacugggcaucagaagaagcuga

SEQ ID NO: 23473 - RNA, 1635 nt, Artificial Sequence
  derived and/or modified sequence opt4 from capsid__Norovirus__ABQ44564
augaugauggccagcaaggacgccacccccagcgccgacggcgccaccggcgccggccagcuggugcccgaggugaacaccgccgaccccauccccaucgaccccguggccggcagcagcaccgcccuggccaccgccggccaggugaaccugaucgaccccuggaucaucaacaacuucgugcaggccccccagggcgaguucaccaucagccccaacaacacccccggcgacgugcuguucgaccugcagcugggcccccaccugaaccccuuccugagccaccugagccagauguacaacggcugggugggcaacaugagagugagaguggugcuggccggcaacgccuucaccgccggcaaggugaucaucugcugcgugccccccggcuuccagagcagaacccugagcaucgcccaggccacccuguucccccacgugaucgccgacgugagaacccuggaccccguggaggugccccuggaggacgugagaaacgugcuguaccacaacaacgacacccagcccaccaugagacugcugugcaugcuguacaccccccugagaaccggcggcgccagcggcggcaccgacagcuucgugguggccggcagagugcugaccugccccggccccgacuucaacuuccuguuccuggugccccccaccguggagcagaagaccagacccuucaccgugcccaacaucccccugaaguaccugagcaacagcagaauccccaaccccaucgagggcaugagccugagccccgaccagacccagaacgugcaguuccagaacggcagaugcaccaucgacggccagccccugggcaccacccccgugagcgugagccagcugugcaaguucagaggcagaaucaccagcggccagaaggugcugaaccugaccgagcuggacggcagccccuucauggccuucgccgcccccgcccccgccggcuuccccgaccugggcagcugcgacuggcacaucgaggugagcaagauccccaacagcagcacccagagcaaccccaucguggugaacagcgugaagcccaacagccagcaguucgugccccaccugagcagcaucacccuggacgacaacgugagcagcggcggcgacuacaucggcaccauccaguggaccagcccccccagcgacagcggcggcgccaacaccaacuucuggaagauccccgacuacggcagcagccuggccgaggccagccagcuggcccccgccguguacccccccggcuucaacgaggugaucguguacuucauggccagcauccccggccccaaccagagcggcagccccaaccuggugcccugccugcugccccaggaguacaucacccacuucaucagcgagcaggcccccauccagggcgaggccgcccugcugcacuacguggaccccgacaccaacagaaaccugggcgaguucaagcuguaccccggcggcuaccugaccugcgugcccaacagcagcagcaccggcccccagcagcugccccuggacggcguguucguguucgccagcugggugagcagauucuaccagcugaagcccgugggcaccgccggccccgccagaggcagacugggcgugagaagauga

SEQ ID NO: 23474 - RNA, 1623 nt, Artificial Sequence
  derived and/or modified sequence opt4 from capsid__Norovirus__ABQ44565
augaugauggccagcaaggacgcccccaccagccccgacggcgccagcggcgccggccagcuggugcccgaggccaacaccgccgagcagaucagcauggaccccguggccggcgccagcaccgccguggccaccgccggccaggugaacaugaucgaccccuggaucuucaacaacuucgugcaggccccccagggcgaguucaccaucagccccaacaacacccccggcgacauccuguucgaccugcagcugggcccccaccugaaccccuuccuggcccaccugagccagauguacaacggcugggugggcaacaugagagugagaauccugcuggccggcaacgccuucaccgccggcaagaucaucaucugcugcgugccccccggcuucgacgccagaauccugaccaucgcccaggccacccuguucccccaccugaucgccgacgugagaacccuggagcccguggagcugccccuggaggacgugagaaacgugcuguuccacaacagcagccagccccagcccaccaugagacugguggccaugcuguacaccccccugagaaccggcggcggcagcggcggcaccgacgccuucgugguggccggcagagugcugaccugccccgcccccgacuucagcuuccuguuccuggugccccccagcguggagcagaagaccagaguguucagcgugcccaacgugccccugaaggaccugagcaacagcagagugcccgugcccauccagggcauguucaugagccccgacgugaaccagagcgugcaguuccagaacggcagaugccagaucgacggccagcugcagggcaccacccccgugagccugagccagcugugcaagaucagaggcaagaccagcagcaacgccagagugcugaaccugagcgagguggacggcagccccuucaucccccuggagagccccgcccccgugggcuuccccgaccugggcggcugcgacuggcacgugaacuucaccuuccaggcccaggaccaggaccccagccagagcgugaccuucgccaccaacgacgccagcuucgugcccuaccugggcagcaucagcccccacaacggcggcgacuuccacagcggcgacaucaucggcagccugggcuggaucagcgcccccagcgacagcagccagcugaacguguggaccauccccaaguacggcagcagccugcccgacgugacccaccuggcccccgccguguucccccccggcuucggcgaggugauccuguacuucuacagcaccuuccccggcagcggccagcccggccagcugcaggugcccugccugcugccccaggaguucaucacccacuucugcaacgagcaggcccccaucgccggcgaggccgcccugcugcacuacguggaccccgacaccggcagaaaccugggcgaguucaagcuguaccccgacggcuucaugaccugcgugcccaacagcgugagcagcggcccccagacccugcccaucaacggcguguucguguucgugagcugggugagcagauucuaccagcugaagcccgugggcaccgccagcguggccagaagacugggccugagaagaaucuga

SEQ ID NO: 23475 - RNA, 1635 nt, Artificial Sequence
  derived and/or modified sequence opt4 from capsid__Norovirus__ABQ44566
augaugauggccagcaaggacgcccccaccaacauggacggcaccagcggcgccggccagcuggugcccgaggccaacaccgccgagcccaucagcauggaccccguggccggcgccgccaccgccguggccaccgccggccagaucaacaugaucgaccccuggaucaugagcaacuucgugcaggccccccagggcgaguucaccgugagccccaacaacacccccggcgacgugcuguucgaccugcagcugggcccccagcugaaccccuuccuggcccaccuggcccagauguacaacggcugggugggcaacaugagagugaaggugcugcuggccggcaacgccuucaccgccggcaagaucaucaucagcugcaucccccccggcuucaccagccagaacaucagcaucgcccagaugaccauguucccccacgugaucgccgacgugagagugcuggagcccaucgaggugccccuggaggacgugagaaacgugcuguuccacaccaacgacaacagacccaccaugagacuggugugcaugcuguacaccccccugagagccaacggcagcagcagcggcaccgaccccuucgugaucgccggcagagugcugaccugccccgacagcaacuucagcuuccuguuccuggugccccccaacguggagcagaagaccagacccuucagcgugcccaacaucccccugaacacccugagcaacagcagagugcccagccugaucaagagcaugaccaucagcagagaccagaaccagaucauccaguuccagaacggcagagugacccuggacggccagcugcagggcaccacccccaccagcgugagccagcugugcaagaucagaggcaccaccuaccacgccaccggcggcaacggcaucaaccugaccgagcugaacggcgagcccuaccacgccuucgagagccccgcccccaucggcuuccccgaccugggcggcugcgacuggcaccugaccgccacccccacccaggccuucaacgacggcgccaagguggugagacugagcgugacccagggcgccgccuucgccccccaccugggcaccauccacuacaccaccaccgacaccgacuacagccccaacaccagcaucaucugcacccuggacuggcugagccagaccaccggccagagcaacguggaccccuggcagauccccaccuacggcagcacccugaccgaggccgcccagcuggccccccccaucuucccccccggcuucggcgagacccugguguucuuccugagcgacuuccccaucagcaacggcaagaacggccugagcgugcccugcacccugccccaggaguucgugacccacuucgugaacgagcaggcccccaucagaggcgaggccgcccugcugcacuacguggaccccgacacccacagaaaccugggcgaguucaagcuguaccccgagggcuucaugaccugcgugcccaacaccagcggcggcggcccccagacccugcccaucaacggcguguucguguucgugagcugggugagcagauucuaccagcugaagcccgugggcaccgccggcgccgccagaagacugggcaucagaagaagcuga

SEQ ID NO: 23476 - RNA, 1608 nt, Artificial Sequence
  derived and/or modified sequence opt4 from capsid__Norovirus__ABQ44567
augaagauggccagcaacgacgccgcccccagcaacgacggcgccgccggccuggugcccgaggugaacaacgagaccauggcccuggagcccguggccggcgccagcaucgccgccccccugaccggccagaacaacgugaucgaccccuggaucagaaugaacuucgugcaggcccccaacggcgaguucaccgugagccccagaaacagccccggcgagauccugcugaaccuggagcugggccccgagcugaaccccuuccuggcccaccugagcagaauguacaacggcuacgccggcggcguggaggugcaggugcugcuggccggcaacgccuucaccgccggcaagcugguguucgccgccauccccccccacuuccccaucgagaaccugagccccggccagaucaccauguucccccacgugaucaucgacgugagaacccuggagcccgugcugcugccccugcccgacgugagaaacaacuucuuccacuacaaccaggagcccgagcccagaaugagacugguggccaugcuguacaccccccugagaagcaacggcagcggcgacgacguguucaccgugagcugcagagugcugaccagacccagccccgacuucgacuucaacuaccuggugccccccaccguggagagcaagaccaagcccuucacccugcccauccugaccaucggcgagcugagcaacagcagauuccccgcccccaucgacgagcuguacaccagccccaacgagggccugguggugcagccccagaacggcagaagcacccuggacggcgagcugcugggcaccacccagcuggugcccagcaacaucugcagccugagaggcagaaucaacgcccaccugcccgacaaccagcacagauggaacaugcaggugaccaacgccaacggcacccccuucgaccccaccgaggacgugcccgccccccugggcacccccgacuuccuggccaacaucuacggcgugaccagccagagaaaccccgacaacaccugcagagcccacgacggcauccuggccaccuggagccccaaguucacccccaagcugggcagcguggugcugggcaccugggaggacagagacuucgacaucaaccagcccaccagauucacccccgugggccuguacgacaccgaccacuucaaccagugggcccugcccaacuacagcggcgcccugacccugaacaugaaccuggcccccagcguggccccccuguuccccggcgagcagcugcuguucuucagaagccacaucccccugaagggcggcaccagcagcggcgccaucgacugccugcugccccaggagugggugcagcacuucuaccaggagagcgcccccagcagcaccgacguggcccugaucagauacaccaaccccgacaccggcagagugcuguucgaggccaagcugcacagacagggcuucaucaccguggccaacagcggcagcagacccaucguggugccccccaacggcuacuucagauucgacagcugggugaaccaguucuacagccuggcccccaugggcaccggcaacggcagaagaagagugcaguga

SEQ ID NO: 23477 - RNA, 1629 nt, Artificial Sequence
  derived and/or modified sequence opt4 from capsid__Norovirus__ABQ44568
augaacauggccagcaacgacgccgcccccagcaccgacggcgccgccggccuggugcccgagagcaacaacgaggugauggcccuggagcccguggccggcgccgcccuggccgcccccgugaccggccagaccaacaucaucgaccccuggaucagagccaacuucgugcaggcccccaacggcgaguucaccgugagccccagaaacgcccccggcgaggugcugcugaaccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccguggagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauuccccgugagcaucgaccagauguacaccagccccaacgaggugaucagcgugcagugccagaacggcagaugcacccuggacggcgagcugcagggcaccacccagcugcaggugagcggcaucugcgccuucaagggcgaggugaccgcccaccugcacgacaacgaccaccuguacaacgugaccaucaccaaccugaacggcagccccuucgaccccagcgaggacauccccgccccccugggcgugcccgacuuccagggcagaguguucggcgugaucagccagagagacaagcagaacgccgccggccacaacgagcccgccaacagaggccacgacgccguggugcccaccuacaccgcccaguacacccccaagcugggccagauccagaucggcaccuggcagaccgacgaccugaccgugaaccagcccgugaaguucacccccgugggccugaacgacaccgagcacuucaaccaguggguggugcccagauacgccggcgcccugaaccugaacaccaaccuggcccccagcguggcccccguguuccccggcgagagacugcuguucuucagaagcuacaucccccugaagggcggcuacggcaaccccgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagagugcaguga

SEQ ID NO: 23478 - RNA, 1647 nt, Artificial Sequence
  derived and/or modified sequence opt4 from capsid__Norovirus__ABQ44569
augaagauggccagcaacgacgccgcccccagcaacgacggcgccgccggccuggugcccgagaucaacaacgaggccauggcccuggaccccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgccuucaccgccggcaagaucaucuucgccgccaucccccccaacuuccccaucgacaaccugagcgccgcccagaucaccaugugcccccacgugaucguggacgugagacagcuggagcccgugaaccugcccaugcccgacgugagaaacaacuucuuccacuacaaccagggcagcgacagcagacugagacugaucgccaugcuguacaccccccugagagccaacaacagcggcgacgacguguucaccgugagcugcagagugcugaccagacccagccccgacuucagcuucaacuuccuggugccccccaccguggagagcaagaccaagcccuucacccugcccauccugaccaucagcgagaugagcaacagcagauuccccgugcccaucgacagccugcacaccagccccaccgagaacaucguggugcagugccagaacggcagagugacccuggacggcgagcugaugggcaccacccagcugcugcccagccagaucugcgccuucagaggcgugcugaccagaagcaccagcagagccagcgaccaggccgacaccgccacccccagacuguucaacuacuacuggcacauccagcuggacaaccugaacggcacccccuacgaccccgccgaggacauccccggcccccugggcacccccgacuucagaggcaagguguucggcguggccagccagagaaaccccgacagcaccaccagagcccacgaggccaagguggacaccaccgccggcagauucacccccaagcugggcagccuggagaucagcaccgagagcgacgacuucgaccagaaccagcccaccagauucacccccgugggcaucggcguggaccacgaggccgacuuccagcaguggagccugcccgacuacagcggccaguucacccacaacaugaaccuggcccccgccguggcccccaacuuccccggcgagcagcugcuguucuucagaagccagcugcccagcagcggcggcagaagcaacggcauccuggacugccuggugccccaggagugggugcagcacuucuaccaggagagcgcccccgcccagacccagguggcccuggugagauacgugaaccccgacaccggcagagugcuguucgaggccaagcugcacaagcugggcuucaugaccaucgccaagaacggcgacagccccaucaccgugccccccaacggcuacuucagauucgagagcugggugaaccccuucuacacccuggcccccaugggcaccggcaacggcagaagaagaauccaguga

SEQ ID NO: 23479 - RNA, 1623 nt, Artificial Sequence
  derived and/or modified sequence opt4 from capsid__Norovirus__ABQ44570
augaagauggccagcaacgacgccgcccccagcaacgacggcgccgccggccuggugcccgagagcaacaacgaggccauggcccuggagcccgugaugggcgccagccuggccgcccccgugaccggccagaccaacaucaucgaccccuggaucagaaccaacuucgugcaggcccccaacggcgaguucaccgugagccccagaaacagccccggcgagauccuggugaaccuggagcugggccccgagcugaaccccuaccuggcccaccuggccagaauguacaacggcuacgccggcggcauggaggugcaggugaugcuggccggcaacgccuucaccgccggcaagaucaucuucgccgccgugccccccuacuuccccguggagaaccugagccccagccagaucaccauguucccccacgugaucaucgacgugagaacccuggagcccgugcugcugcccaugcccgacgugagaagcacccuguuccacuucaaccagaaggacgagcccaagaugagacugguggccaugcuguacaccccccugagaagcaacggcagcggcgacgacguguucaccgugagcugcagaauccugaccagacccagccccgaguucgacuucaccuaccuggugccccccaccguggagagcaagaccaagcccuucacccugcccgugcugacccugggcgagcugagcaacagcagauucccccugagcaucgacgagauggugaccagccccaacgagagcaucguggugcagccccagaacggcagagugacccuggacggcgagcugcugggcaccacccagcugcaggccugcaacaucugcagcaucagaggcaaggugaccggccaggugcccaacgagcagcacauguggaaccuggaggugaccaaccugaacggcacccaguucgaccccaccgacgacgugcccgccccccugggcgugcccgacuucgccggcgagguguucggcgugcugagccagagaaacagaggcgagagcaaccccgccaacagagcccacgacgccgugguggccaccuacagcgacaaguacacccccaagcugggccuggugcagaucggcaccuggaacaccaacgacguggagaaccagcccaccaaguucacccccaucggccugaacgagguggccaacggccacagauucgagcaguggacccugcccagauacagcggcgcccugacccugaacaugaaccuggcccccgccguggccccccuguuccccggcgagagacugcuguucuucagaagcuacaucccccugaagggcggcuucggcaaccccgccaucgacugccuggugccccaggagugggugcagcacuucuaccaggagagcgcccccagccugggcgacguggcccuggugagauacgugaaccccgacaccggcagagugcuguucgaggccaagcugcacaagggcggcuuccugaccgugagcagcaccagcaccggccccgugguggugcccgccaacggcuacuucagauucgacagcugggugaaccaguucuacagccuggcccccaugggcaccggcaacggcagaagaagauuccaguga

SEQ ID NO: 23480 - RNA, 1653 nt, Artificial Sequence
  derived and/or modified sequence opt4 from capsid__Norovirus__ABQ44571
augaagauggccagcaacgacgccgcccccagcaacgacggcgccgccaaccuggugcccgaggccaacaacgaggugauggcccuggagcccguggugggcgccagcaucgccgcccccguggugggccagcagaacaucaucgaccccuggaucagagagaacuucgugcaggccccccagggcgaguucaccgugagccccagaaacagccccggcgagaugcugcugaaccuggagcugggccccgagcugaaccccuaccugagccaccugagcagaauguacaacggcuacgccggcggcaugcaggugcagguggugcuggccggcaacgccuucaccgccggcaagaucaucuucgccgccgugcccccccacuuccccguggacaacaucagcgccgcccagaucaccaugugcccccacgugaucguggacgugagacagcuggagcccgugcugcugccccugcccgacaucagaaacagauucuuccacuacaaccaggagaacacccccagaaugagacugguggccaugcuguacaccccccugagagccaacagcggcgaggacguguucaccgugagcugcagagugcugaccagacccgcccccgacuucgaguucaccuuccuggugccccccaccguggagagcaagaccaagcccuucacccugcccauccugacccugggcgagcugagcaacagcagauuccccgccgccaucgacaugcuguacaccgaccccaacgagagcaucguggugcagccccagaacggcagaugcacccuggacggcacccugcagggcaccacccagcuggugcccacccagaucugcgccuucagaggcacccugaucagccagaccgccagagccgccgacagcaccgacagcccccagagagccagagaccacccccugcacgugcaggugaagaaccuggacggcacccaguacgaccccaccgacgacauccccgccgugcugggcgccaucgacuucaagggcaccguguucggcguggccagccagagagacgugagcggcccccaggagcagggccacuacgccaccagagcccacgaggcccacaucgacaccaccgaccccaaguacgcccccaagcugggcaccauccugaucaagagcgagagcaacgacuucaucaccaaccagcccaucagauucacccccgugggcaugggcgacaacaacuggagacagugggagcugcccgacuacagcggcagacugacccugaacaugaaccuggcccccgccgugagccccagcuuccccggcgagagaauccuguucuucagaagcaucgugcccagcgccggcggcuacggcagcggcuacaucgacugccugaucccccaggagugggugcagcacuucuaccaggaggccgcccccagccagagcgccguggcccuggugagauacgugaaccccgacaccggcagaaacaucuucgaggccaagcugcacagagagggcuuccugaccguggccaacagcggcaacaaccccaucguggugccccccaacggcuacuucagauucgaggccugggugaaccaguucuacacccuggcccccaugggcagcggccagggcagaagaagagcccaguga

SEQ ID NO: 23481 - RNA, 1623 nt, Artificial Sequence
  derived and/or modified sequence opt4 from capsid__Norovirus__ABQ44572
augaagauggccagcaacgacgccgcccccagcagcgacggcgccgccggccuggugcccgagaucaacaacgaggugaugccccuggaccccguggccggcgccagccuggccacccccguggugggccagcagaacaucaucgaccccuggaucagaaacaacuucgugcaggcccccgccggcgaguucaccgugagccccagaaacagccccggcgagauccugcuggaccuggagcugggccccgagcugaaccccuaccuggcccaccuggccagaauguacaacggccacgccggcggcauggaggugcagaucgugcuggccggcaacgccuucaccgccggcaagaucaucuucgccgccaucccccccggcuuccccuacgagaaccugagccccagccagaucaccaugugcccccacgugaucaucgacgugagacagcuggagcccgugcugcugcccaugcccgacaucagaaacaacuucuuccacuacaaccagggcaacgaccccaagcugagacugguggccaugcuguacaccccccugagagccaacaacagcggcgacgacguguucaccgugagcugcagagugcugaccaagcccagccccgacuucgaguucaccuuccuggugccccccaccguggagagcaagaccaagcaguucacccugcccauccugaagaucagcgagaugaccaacagcagauuccccgugcccguggacgugauguacaccgccagaaacgagaaccagguggugcagccccagaacggcagagugacccuggacggcgagcugcugggcaccaccccccugcuggccgugaacaucugcaaguucaagggcgaggugaucgccaagaacggcgacgugagaagcuacagaauggacauggagaucaccaacaccgacggcacccccaucgaccccaccgaggacacccccggccccaucggcagccccgacuuccagggcauccuguucggcguggccagccagagaaacaagaacgagcagaaccccgccaccagagcccacgaggccaacaucaacaccggcggcgaccaguacgcccccaagcuggcccaggugaaguucuucagcgagagccaggacuucgaggugcaccagcccaccaccuucacccccgugggcguggccggcgacaacagccaccccuucagacaguggacccugcccagauacggcggccaccugaccaacaacacccaccuggcccccgccguggccccccuguuccccggcgagcagcugcuguucuucagaagccagauccccagcagcggcggccacgagagcggcuacauggacugccuggugccccaggagugggugcagcacuucuaccaggaggccgccaccgcccagagcgagguggcccugaucagauucaucaaccccgacaccggcagagugcuguucgaggccaagcugcacaagcagggcuucaucaccguggcccacaccggcgacaaccccaucgugaugccccccaacggcuacuucagauucgaggccugggugaaccaguucuacagccuggcccccgugggcaccggcaacggcagaagaagagugcaguga

SEQ ID NO: 23482 - RNA, 1608 nt, Artificial Sequence
  derived and/or modified sequence opt4 from capsid__Norovirus__ABQ44573
augaagauggccagcaacgacgccgcccccagcaacgacggcgccgccggccuggugcccgaggccaacaacgagaccauggcccuggagcccguggccggcgccagcaucgccgccccccugaccggccagaacaacaucaucgaccccuggaucagacugaacuucgugcaggcccccaacggcgaguucaccgugagccccagaaacagccccggcgaggugcugcugaaccuggagcugggccccgagcugaaccccuaccuggcccaccugagcagaauguacaacggcuacgccggcggcguggaggugcaggugcugcuggccggcaacgccuucaccgccggcaagcugguguucgccgccgugcccccccacuucccccuggagaacaucagccccggccagaucaccauguucccccacgugaucaucgacgugagaacccuggagcccgugcugcugccccugcccgacgugagaaacaacuucuuccacuacaaccagcagaacgagcccagaaugagacugguggccaugcuguacaccccccugagaagcaacggcagcggcgacgacguguucaccgugagcugcagagugcugaccagacccagccccgacuucgacuucaacuaccuggugccccccaccguggagagcaagaccaagcccuucacccugcccauccugaccaucggcgagcugaccaacagcagauuccccgugcccaucgacgagcuguacaccagccccaacgagagccugguggugcagccccagaacggcagaugcgcccuggacggcgagcugcagggcaccacccagcugcugcccaccgccaucugcagcuucagaggcagaaucaaccagaaggugagcggcgagaaccacguguggaacaugcaggugaccaacaucaacggcacccccuucgaccccaccgaggacgugcccgugccccugggcacccccgacuucagcggcaagcuguucggcgugcugagccagagagaccacgacaacgccugcagaagccacgacgccgugaucgccaccaacagcgccaaguucacccccaagcugggcgccauccagaucggcaccugggaggagaacgacgugcacaucaaccagcccaccaaguucacccccgugggccuguucgaggacgagggcuucaaccaguggacccugcccaacuacagcggcgcccugacccugaacgugggccuggccccccccguggcccccaccuuccccggcgagcagauccuguucuucagaagccacaucccccugaagggcggcguggccgaccccgugaucgacugccugcugccccaggaguggauccagcaccuguaccaggagagcgcccccagccagagcgacguggcccugaucagauucaccaaccccgacaccggcagagugcuguucgaggccaagcugcacagaagcggcuacaucaccguggccaacaccggcagcagacccaucguggugcccgccaacggcuacuucagauucgacagcugggugaaccaguucuacagccuggcccccaugggcaccggcaacggcagaagaagagugcaguga

SEQ ID NO: 23483 - RNA, 1614 nt, Artificial Sequence
  derived and/or modified sequence opt4 from capsid__Norovirus__ABQ44574
augaagauggccagcaacgacgccacccccagcgacgacggcgccgccggccuggugcccgagaucaacaacgaggugauggcccuggagcccguggccggcgccagcaucgccgcccccguggugggccagcagaacaucaucgaccccuggaucagaaacaacuucgugcaggcccccgccggcgaguucaccgugagccccagaaacagccccggcgagcugcugcuggaccuggagcugggccccgagcugaaccccuaccuggcccaccuggccagaauguacaacggccacgccggcggcauggaggugcagaucgugcuggccggcaacgccuucaccgccggcaagauccuguucgccgccaucccccccagcuuccccuacgagaaccugagccccgcccagcugaccaugugcccccacgugaucguggacgugagacagcuggagcccgugcugcugcccaugcccgacaucagaaacguguucuaccacuacaaccagaacaacagccccaagcugagacugguggccaugcuguacaccccccugagagccaacaacagcggcgacgacguguucaccgugagcugcagagugcugaccagacccagccccgacuuccaguucaccuuccuggugccccccaccguggagagcaagaccaagaacuucacccugcccgugcugagagugagcgagaugaccaacagcagagugcccagaugcuucggcaccaagugcauccaggccagaaacgagaacaucaucgugcagccccagaacggcagaugcaccaccgacggcgagcugcugggcaccaccacccugcagagcgugagcaucugcaacuucagaggcaccaugcaggccaagcugaacgagcagcccagauaccagcugcagcugaccaaccuggacggcagccccaucgaccccaccgacgacaugcccgccccccugggcacccccgacuuccaggccaugcuguacggcguggccagccagagaagcagcagagacaacgccaccagagcccacgacgcccagaucgacaccgccggcgacaccuucgcccccaagaucggccaggugagauucaagagcagcagcggcgacuucgaccugcacgaccccaccaaguucacccccaucggcgugaacguggacgaccagcaccccuucagacaguggagccugcccaacuacggcggccaccuggcccugaacaaccaccuggcccccgccgugaccccccuguuccccggcgagcagauccuguucuucagaagccacauccccagcgccggcggccacaccgacggcgccauggacugccugcugccccaggaguggaucgagcacuucuaccaggaggccgcccccagccagagcgacaucgcccuggugagauucaucaaccccgacaccggcagagugcugcuggaggccaagcugcacaagcagggcuuccugaccguggccgccagcggcgaccaccccaucgugaugcccaccaacggcuacuucagauucgaggccugggugaaccccuucuacacccuggcccccgugggcaccggcagcggcagaagaagaauccaguga

SEQ ID NO: 23484 - RNA, 1641 nt, Artificial Sequence
  derived and/or modified sequence opt4 from capsid__Norovirus__ABQ44575
augaagauggccagcaacgacgccgcccccagcaacgacggcgccgccagccuggugcccgagggcaucaacgagaccaugccccuggagcccguggccggcgccagcaucgccgcccccguggccggccagaccaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccaucccccccaacuuccccguggacaugaucagccccgcccagaucaccaugcugccccaccugaucguggacgugagaacccuggagcccaucaugaucccccugcccgacgugagaaacguguucuaccacuucaacaaccagccccagcccagaaugagacugguggccaugcuguacaccccccugagaagcaacggcagcggcgacgacguguucaccgugagcugcagagugcugaccagacccacccccgacuucgaguucaucuaccuggugccccccagcguggagagcaagaccaagcccuucacccugcccauccugaccaucagcgagcugaccaacagcagauuccccauccccaucgagcagcuguacaccgcccccaacgagaccaacguggugcagugccagaacggcagaugcacccuggacggcgagcugcagggcaccacccagcugcugagcagcgccgugugcagcuacagaggcagaaccguggccaacaacggcgacaacugggaccagaaccugcugcagcugaccuaccccaacggcgccagcuacgaccccaccgacgaggugcccgccccccugggcacccaggacuucagcggcaugcuguacggcgugcugacccaggacaacgugaacgugagcaccggcgaggccaagaacgccaagggcaucuacaucagcaccaccagcggcaaguucacccccaagaucggcagcaucggccugcacagcaucaccgagcacgugcaccccaaccagcagagcagauucacccccgugggcguggccgugaacgagaacacccccuuccagcagugggugcugccccacuacgccggcagccuggcccugaacaccaaccuggcccccgccguggcccccaccuuccccggcgagcagcugcuguucuucagaagcagagugcccugcgugcagggccugcagggccaggacgccuucaucgacugccugcugccccaggagugggugaaccacuucuaccaggaggccgcccccgcccccgcccccagccaggccgacguggcccugaucagauacgugaaccccgacaccggcagaacccuguucgaggccaagcugcacagaagcggcuucaucaccgugagccacaccggcgccuacccccugguggugccccccaacggccacuucagauucgacagcugggugaaccaguucuacagccuggcccccaugggcaccggcaacggcagaagaagaauccaguga

SEQ ID NO: 23485 - RNA, 1623 nt, Artificial Sequence
  derived and/or modified sequence opt4 from capsid__Norovirus__ABQ44576
augaagauggccagcaacgacgccgcccccagcaacgacggcgccgccggccuggugcccgaggugaacaacgagacccuggcccuggagcccguggccggcgccagcaucgccgccccccugaccggccagaacaacgugaucgaccccuggaucagacugaacuucgugcaggcccccaacggcgaguucaccgugagccccagaaacagccccggcgagauccugcugaaccuggagcugggccccgagcugaaccccuaccuggcccaccuggccagaauguacaacggcuacgccggcggcguggaggugcaggugcugcuggccggcaacgccuucaccgccggcaagcugguguucgccgccauccccccccacuuccccguggacaaccugagccccggccagaucaccauguucccccacgugaucaucgacgugagaacccuggagcccgugcugcugccccugcccgacgugagaaacagcuucuuccacuacaaccagcagagcgaccagagaaugagacugaucgccaugcuguacaccccccugagaagcaacggcagcggcgacgacguguucaccgugagcugcagagugcugaccagacccagccccgacuucgacuucaacuaccuggugccccccaccguggagagcaagaccaagcccuucagcgugcccgugcugacccugaacgagcugaccaacagcagauuccccgugcccaucgacgccauguacaccagccccaacgacagcaucguggugcagccccagaacggcagagccaccaucgacggcgagcugcugggcaccacccagcugauccccagcggcaucugcagcuucagaggcaagaucaccacccaccugagcgacgacagacaccuguggaacauccaggugaccaaccugaacggcacccccuucgaccccaccgacgacgugcccgccccccugggcaugcccgacuucagcggccagaucuucggcguggugagccagagagacaccggcaccaaccccgccaacagagcccacgacgccgugcuggccaccuacagcgccaaguacacccccaagcugggcagcgugcagaucggcaccugggacaccgaggaccugcuggagagacagcccgugaaguucacccccgugggccugaacgagaucggccaggacaagcacuucgaccagugggugcugcccaacuacagcggcgcccugggccugaacaugcaccuggcccccgccgugagcccccuguuccccggcgagagacugcuguucuucagaagcuacaucccccugaagggcggccacggcgaccccuucaucgacugccuggugccccaggaguggauccagcacuucuaccaggagagcgcccccgcccagagcagcguggcccugcugagauacgugaaccccgacaccggcagaacccuguucgaggccaagcugcacaaggagggcuucaucaccgugagcagcaccgagaacagacccgugguggugccccccaacggcuacuucagauucgacagcugggugaaccaguucuacagccuggcccccaugggcaccggcaacggcagaagaagaaugcaguga

SEQ ID NO: 23486 - RNA, 1569 nt, Artificial Sequence
  derived and/or modified sequence opt4 from capsid__Norovirus__ACJ04900
augaagaugaccgacagagacaccaucgacagcgcccccgcccugggccaggugcugccccccgagguggaggccagcgugcccguggagcccaccgccggcgcccccguggccgcccccaccgccggccaggugaaccccaucgaccccuggaucuucgccaacuucgugcaggccccccagggcgaguucaccaucagccccaacaacaaccccggcgagauccuguucgagcuggagcugggccccgaccugaaccccuaccuggcccaccugagaagaauguacaacggcuggaccggcagcaugagagugagagugcugcuggccggcaacgccuucagcgccggcaagguggugguguucugcgugccccccggcuucgacaccagcuaccugacccccagccaggccacccaguucccccacgugcugaucgacgugagagcccccgagcccguggagaugccccuggaggacgugagaaacauccuguuccaccagggccccgacagcagaaugagacugaugggcaugcuguacaccccccugagagccaacagcggcgccgaccccuucguggugaccggcagagugcugaccugccccagccccaacuucagcuucuucuuccuggugccccccaccguggaggagagagagacccccuucacccugcccaaccugcccgugaacagccugagccacagcagagccauggagcccaucgcccagaugaugagcagcagaaacuuccccgccagcgugcaguuccagaacggcagaugcacccugagcggcgaccugcugggcaccacccccagcagccccgccgacgugggcaccuucgugggccugaucgccgagcccggcagccacgugguggagcugagccagcccaaccaggaggacuuccacgccggcagcgcccccgcccccuucggcuuccccgacuucagcgacugcagccugaccuucgugguggccagcgccagcaccgugggcgagagaaccgugaacaccagaagcccccagaacuucacccccgcccugggccacaucaccuucgacgaggaggcccccgccgaccuguucagagcccaccugagaaaccugugggaccccaccgagcacagcuucuggagaauccccgacuacagagccgacgugcugggcggcgaguucgcccccagcgugagcgcccccggcgugggcgagacccugcuguucuucaugugcaacgugcccagaagcaacggcgccaaccccaaccccugccccugccugcugccccaggaguggaucacccacuucgugagcgagagagccgcccugcagagcgacguggcccugcugaacuacaucaaccccaacaccggcagagugcuguucgagugcaagcuguacgccaacggcuuccugaccgugaaccugggcgccagcgaccaggccacccugcccguggacggcaucuucaaguucgugagcugggugagcuucuacuaccagcugagacccgugggcaacaucggcgugggcagaagacugcccagacuggacggcuucuga

SEQ ID NO: 23487 - RNA, 1569 nt, Artificial Sequence
  derived and/or modified sequence opt4 from capsid__Norovirus__ACJ04903
augaagaugaccgacagagacaccaucgacagcgcccccgcccugggccaggugcugccccccgagguggaggccagcgugcccguggagcccaccgccggcgcccccguggccgcccccaccgccggccaggugaaccccaucgaccccuggaucuucgccaacuucgugcaggccccccagggcgaguucaccaucagccccaacaacaaccccggcgagauccuguucgagcuggagcugggccccgaccugaaccccuaccuggcccaccugagaagaauguacaacggcuggaccggcagcaugagagugagagugcugcuggccggcaacgccuucagcgccggcaagguggugguguucugcgugccccccggcuucgacaccagcuaccugacccccagccaggccacccaguucccccacgugcugaucgacgugagagcccccgagcccguggagaugccccuggaggacgugagaaacauccuguuccaccagggccccgacagcagaaugagacugaugggcaugcuguacaccccccugagagccaacagcggcgccgaccccuucguggugaccggcagagugcugaccugccccagccccaacuucagcuucuucuuccuggugccccccaccguggaggagagagagacccccuucacccugcccaaccugcccgugaacagccugagccacagcagagugauggagcccaucgcccagaugaugagcagcagaaacuuccccgccagcgugcaguuccagaacggcagaugcacccugagcggcgaccugcugggcaccacccccagcagccccgccgaccugggcaccuucgugggccugaucgccgagcccggcagccacguggccgagcugagccagcccaaccaggaggacuuccacgccggcagcgcccccgcccccuucggcuuccccgacuucagcgagugcagccugaccuucgugguggccagcgccagcaccgugggcgagagaaccgugaacaccagaagccugcagaacuucacccccgcccugggccacaucaccuucgacgaggaggcccccgccgaccuguucagagcccaccugagaaaccugugggaccccaccgagcacagcuucuggagaauccccgacuacagagccgacgugcugggcggcgaguucgcccccagcgugagcgcccccggcgugggcgagacccugcuguucuucaugugcaacgugcccagacugaacggcgccaaccccaaccccugccccugccugcugccccaggaguggaucacccacuucgugagcgagagagccgcccugcagagcgacguggcccugcugaacuacaucaaccccaacaccggcagagugcuguucgagugcaagcuguacgugaacggcuuccugaccgugaaccugggcgccagcgaccaggccacccugcccguggacggcaucuucaaguucgugagcugggugagcuucuacuaccagcugagacccgugggcaacaucggcgugggcagaagacugcccagacuggacggcuucuga

SEQ ID NO: 23488 - RNA, 1569 nt, Artificial Sequence
  derived and/or modified sequence opt4 from capsid__Norovirus__ACJ04906
augaagaugaccgacagagacgugaccgacagcgcccccgcccugggccaggugcugccccccgagguggaggccagcgugcccguggagcccaccgccggcgcccccguggccgcccccaccgccggccaggugaaccccaucgaccccuggaucuucgccaacuucgugcaggccccccagggcgaguucaccaucagccccaacaacaaccccggcgagauccuguucgagcuggagcugggccccgaccugaaccccuaccuggcccaccugagaagaauguacaacggcuggaccggcagcaugagagugagagugcugcuggccggcaacgccuucagcgccggcaagguggugguguucugcgugccccccggcuucgacaccagcuaccugacccccagccaggccacccaguucccccacgugcugaucgacgugagagcccccgagcccguggagaugccccuggaggacgugagaaacauccuguuccaccagggccccgacagcagaaugagacugaugggcaugcuguacaccccccugagagccaacagcggcgccgaccccuucguggugaccggcagagugcugaccugccccagccccaacuucagcuucuucuuccuggugccccccaccguggaggagagagagccccccuucacccugcccaaccugcccgugaacaaccugagccacagcagagugauggagcccaucgcccagaugaugagcagcagaaacuuccccgccagcgugcaguuccagaacggcagaugcacccugagcggcgaccugcugggcaccacccccagcagccccagcgaccugggcgccuucgugggccugaucgccgagcccggcagcagagugguggagcugagccagcccaaccaggaggacuuccacgccggcagcgcccccgcccccuucggcuuccccgacuucagcgacugcagccugaccuucgugguggccagcgccaccaccgugggcgagagaaccgugaacgccagaagcccccagaacuucacccccgcccugggccacaucaccuucgacgaggaggcccccgccgaccuguucagagcccaccugagaaaccugugggaccccaccgagcacagcuucuggagaauccccgacuacagagccgacgugcugggcagcgaguucgcccccagcgugagcgcccccggcgugggcgagacccugcuguucuucaugugcaacgugcccagacugaacggcgccaaccccaaccccugccccugccugcugccccaggaguggaucacccacuucgugagcgagagagccgcccugcagagcgacguggcccugcugaacuacgugaaccccaacaccggcagagugcuguucgaggccaagcuguacgccaacggcuuccugaccgugaaccugggcgccagcgaccaggccacccugcccguggacggcaucuucaaguucgugagcugggugagcuucuacuaccagcugagacccgugggcaacgccagcgugggcagaagacugcccagacuggacggcuucuga

SEQ ID NO: 23489 - RNA, 1623 nt, Artificial Sequence
  derived and/or modified sequence opt4 from capsid__Norovirus__ACY00565
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagagcggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacguggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23490 - RNA, 1623 nt, Artificial Sequence; identical to SEQ ID NO: 23316
  derived and/or modified sequence opt4 from capsid__Norovirus__ACY00568

SEQ ID NO: 23491 - RNA, 1623 nt, Artificial Sequence
  derived and/or modified sequence opt4 from capsid__Norovirus__ACY00571
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccaaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23492 - RNA, 1623 nt, Artificial Sequence
  derived and/or modified sequence opt4 from capsid__Norovirus__ACY00573
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23493 - RNA, 1623 nt, Artificial Sequence
  derived and/or modified sequence opt4 from capsid__Norovirus__ACY00576
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccacaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcggcaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacagcagauucgaccccugggugaaccaguucuacacccuggcccccaugggcaacggcaccggcagaagaagagcccuguga

SEQ ID NO: 23494 - RNA, 1623 nt, Artificial Sequence
  derived and/or modified sequence opt4 from capsid__Norovirus__ACY00579
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccagcaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccacaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcggcaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23495 - RNA, 1623 nt, Artificial Sequence
  derived and/or modified sequence opt4 from capsid__Norovirus__ACY00582
augaagauggccagcaacgacgccaaccccagcgacggcagcguggccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaugaucguggacgugagacagcuggagcccgugcugaucccccugcccgacgugagaaacaacuucuaccacuacaaccagagcaacgacagcaccaucaagcugaucgccaugcuguacaccccccugagagccgacaacgccggcgaggacguguucaccgugagcugcagagugcugaccagacccagccccgacuucgacuucaucuuccuggugccccccaccguggagagcaagaccaagcccuucaccgugcccauccugaccguggaggagaugaccaacagcagauuccccaucccccuggagaagcuguucaccggccccagcagcaccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacagcagauucgacagcugggugaaccaguucuacacccuggcccccaugggcaacggcaccggcagaagaagagcccuguga

SEQ ID NO: 23496 - RNA, 1623 nt, Artificial Sequence
  derived and/or modified sequence opt4 from capsid__Norovirus__ACY00588
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggccauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagccugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23497 - RNA, 1623 nt, Artificial Sequence
  derived and/or modified sequence opt4 from capsid__Norovirus__ACY00594
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagcccaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcacccacggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23498 - RNA, 1623 nt, Artificial Sequence
  derived and/or modified sequence opt4 from capsid__Norovirus__ACY00597
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucgugggcgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucaagggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23499 - RNA, 1623 nt, Artificial Sequence
  derived and/or modified sequence opt4 from capsid__Norovirus__ACY00600
augaagauggccagcaacgacgccaaccccagcgacggccccgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagcaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacacccagaacgacuucgagacccaccagaacaccaaguucacccccgugggcgugauccaggacggcggcaccacccacagaaacgagccccagcagugggugcugcccagcuacagcggcagaaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcagauacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23500 - RNA, 1623 nt, Artificial Sequence
  derived and/or modified sequence opt4 from capsid__Norovirus__ACY00603
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgcccugaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcccacccagaccaccaagggcgacggcagcaccagaggccacaaggccaccguguacaccggcagcgcccccuucacccccaagcugggcagcgugcaguucagcaccgacaccgagaacgacuucgaggcccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23501 - RNA, 1623 nt, Artificial Sequence
  derived and/or modified sequence opt4 from capsid__Norovirus__ACY00606
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcagaugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacggccuggugaucccccccaacggcuacuucagauucgacagcugggugaaccaguucuacacccuggcccccaugggcaacggcaccggcagaagaagagcccuguga

SEQ ID NO: 23502 - RNA, 1623 nt, Artificial Sequence
  derived and/or modified sequence opt4 from capsid__Norovirus__ACY00609
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccgaccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugcccccugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23503 - RNA, 1623 nt, Artificial Sequence
  derived and/or modified sequence opt4 from capsid__Norovirus__ACY00612
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucaugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23504 - RNA, 1632 nt, Artificial Sequence
  derived and/or modified sequence opt4 from capsid__Norovirus__ACY00615
augaugauggccagcaaggacgcccccaccaacauggacggcaccagcggcgccggccagcuggugcccgaggccaacaccgccgagccccugcccaucaagcccguggccggcgccgccaccgccguggccaccgccggccaggugaacaugaucgaccccuggaucaugaacaacuucgugcaggccccccagggcgaguucaccaucagccccaacaacacccccggcgacauccuguucgaccugcagcugggcccccaccugaaccccuuccuggcccaccugagcagaauguacaacggcugggugggcaacaugcaggugagaaucaugcuggccggcaacgccuucagcgccggcaagaucaucgugugcugcaucccccccggcuucagcagccagagcaucagcaucgcccaggccaccauguucccccacgugaucgccgacgugagagugcuggagcccaucgacgugccccuggacgacgugagaaacgugcuguuccacaacaacgacaacccccagaccaugagacugcugugcaugcuguacaccccccugagaagcggcggcaccagcagcggcaccgaccccuucgugaucgccggcagagugcugaccugccccacccccgacuucagcuuccuguuccuggugccccccgacaucgagcagagaaccaagcccuucagcgugcccaacauccccaugaaccugaugagcaacagcagagugagcaugcugaucgacggcaugauggugagcaacgaccagaaccaggugccccaguuccagaacggcagagugacccuggacggccagcugcaggacaccaccaccgugagcgccgccugcguggccagaaugagaggcagaaucuucaacaacaacggcaacuacggcgugaaccugaccgagcuggacggcaaccccuaccacgccuucgacagccccgccccccugggcuuccccgacuucggcaacugcgaccugcacaugaccuucgugaagaucaaccccaacgagcugagcagcggcgaccccagcggcaagguggugauccacagcuacgacgccaccuucgccccccaccugggcaccgugaagcuggagaacgacgacgagcuggccagauucgugggcaaggagguggugcuggagcugaccugggugagcaacagagagggcgccacccugaaccugugggccgugcccaacuacggcagcagccugacccaggccagccagcuggccccccccaucuacccccccggcuucggcgaggccaucguguacuucaccagcaccuuccccaccgugagcaaccccaaggugcccugcacccugccccaggaguucgugagccacuucgugaacgagcaggcccccaccagaggcgacgccgcccugcugcacuacguggaccccgacacccacagaaaccugggcgaguucaagauguaccccgagggcuacaugaccugcgugcccaacgccggcggcggcccccagacccugcccaucaacggcguguucguguucaucagcugggugagcagauacuaccagcugaagcccgugggcaccgccggcgccgccagaagacugggccugagaagaagcuga

SEQ ID NO: 23505 - RNA, 1623 nt, Artificial Sequence
  derived and/or modified sequence opt4 from capsid__Norovirus__ACY00618
augaugauggccagcaaggacgcccccaccagccccgacggcgccagcggcgccggccagcuggugcccgaggccaacaccgccgagcagaucagcauggaccccguggccggcgccagcaccgccguggccaccgccggccaggugaacaugguggaccccuggaucuucaacaacuucgugcaggccccccagggcgaguucaccaucagccccaacaacacccccggcgacauccuguucgaccugcagcugggcccccaccugaaccccuuccuggcccaccugagccagauguacaacggcugggugggcaacaugagagugagaauccugcuggccggcaacgccuucaccgccggcaagaucaucaucugcugcgugccccccggcuucgacgccagaauccugaccaucgcccaggccacccuguucccccaccugaucgccgacgugagaacccuggagcccguggagcugccccuggaggacgugagaaacgugcuguaccacaacagcagccagccccagcccaccaugagacugguggccaugcuguacaccccccugagaaccggcggcggcagcggcggcaccgacgccuucgugguggccggcagagugcugaccugccccgcccccgacuucagcuuccuguuccuggugccccccagcguggagcagaagaccagaguguucagcgugcccaacaucccccugaaggaccugagcaacagcagagugcccgugcccauccagggcauguucaugagccccgacgugaaccagagcgugcaguuccagaacggcagaugccagaucgacggccagcugcagggcaccacccccgugagccugagccagcugugcaagaucagaggcaagaccagcagcaacgccagagugcugaaccugagcgagguggacggcacccccuucaucccccuggagagccccgcccccgugggcuuccccgaccugggcggcugcgacuggcacgugaacuucaccuuccagacccaggacagagaccccagccagagcgugaccuucgccaccaacgacgccagcuucgugcccuaccugggcagcgugagcccccacaacggcgagggcuuccaggccggcgacaucaucggcagccugggcuggaucagcgcccccagcgacaacagccaguucaacgugugggccauccccaaguacggcagcagccugcccgacgugacccaccuggcccccgccguguucccccccggcuucggcgaggugauccuguacuucuacagcaccuuccccggcagcggccagcccagccagcugcaggugcccugccugcugccccaggaguucaucacccacuucugcaacgagcaggcccccaucgccggcgaggccgcccugcugcacuacguggaccccgacaccggcagaaaccugggcgaguucaagcuguaccccgacggcuucaugaccugcgugcccaacagcgugagcagcggcccccagacccugcccaucaacggcguguucguguucgugagcugggugagcagauucuaccagcugaagcccgugggcaccgccagcgccgccagaagacugggccugagaagaaucuga

SEQ ID NO: 23506 - RNA, 1623 nt, Artificial Sequence
  derived and/or modified sequence opt4 from capsid__Norovirus__ACY00621
augaugauggccagcaaggacgcccccaccagccccgacggcgccagcggcgccggccagcuggugcccgaggccaacaccgccgagcagaucagcauggaccccguggccggcgccagcaccgccguggccaccgccggccaggugaacaugaucgaccccuggaucuucaacaacuucgugcaggccccccagggcgaguucaccaucagccccaacaacacccccggcgacauccuguucgaccugcagcugggcccccaccugaaccccuuccuggcccaccugagccagauguacaacggcugggugggcaacaugagagugagaauccugcuggccggcaacgccuucaccgccggcaagaucaucaucugcugcgugccccccggcuucgacgccagaauccugaccaucgcccaggccacccuguucccccaccugaucgccgacgugagaacccuggagcccguggagcugccccuggaggacgugagaaacgugcuguaccacaacagcagccagccccagcccaccaugagacugguggccaugcuguacaccccccugagaaccggcggcggcagcggcggcaccgacgccuucgugguggccggcagagugcugaccugccccgcccccgacuucagcuuccuguuccuggugccccccagcguggagcagaagaccagaguguucagcgugcccaacaucccccugaaggaccugagcaacagcagagugcccgugcccauccagggcauguucaugagccccgacgugaaccagagcgugcaguuccagaacggcagaugccagaucgacggccagcugcagggcaccacccccgugagccugagccagcugugcaagaucagaggcaagaccagcagcaacgccagagugcugaaccugagcgagguggacggcacccccuucaucccccuggagagccccgcccccgugggcuuccccgaccugggcggcugcgacuggcacgugaacuucaccuuccagacccaggacagagaccccagccagagcgugaccuucgccaccaacgacgccagcuucgugcccuaccugggcagcgugagcccccacaacggcgagggcuuccaggccggcgacaucaucggcagccugggcuggaucagcgcccccagcgacaacagccaguucaacgugugggccauccccaaguacggcagcagccugcccgacgugacccaccuggcccccgccguguucccccccggcuucggcgaggugauccuguacuucuacagcaccuuccccggcagcggccagcccagccagcugcaggugcccugccugcugccccaggaguucaucacccacuucugcaacgagcaggcccccaucgccggcgaggccgcccugcugcacuacguggaccccgacaccggcagaaaccugggcgaguucaagcuguaccccgacggcuucaugaccugcgugcccaacagcgugagcagcggcccccagacccugcccaucaacggcguguucguguucgugagcugggugagcagauucuaccagcugaagcccgugggcaccgccagcgccgccagaagacugggccugagaagaaucuga

SEQ ID NO: 23507 - RNA, 1611 nt, Artificial Sequence
  derived and/or modified sequence opt4 from capsid__Norovirus__ACY00623
augaagauggccagcaacgacgccacccccagcgacgacggcgccgccggccuggugcccggcaucaacagcgaggugauggcccuggagcccguggccggcgccagcaucgccgcccccguggugggccagcagaacaucaucgaccccuggaucagaaacaacuucgugcaggcccccgccggcgaguucaccgugagccccagaaacagccccggcgagcugcugcuggaccuggagcugggccccgagcugaaccccuaccuggcccaccuggccagaauguacaacggccacgccggcggcauggaggugcagaucgugcuggccggcaacgccuucaccgccggcgagauccuguucgccgccaucccccccagcuuccccuacgagaaccugagccccgcccagcugaccaugugcccccacgugaucguggacgugagacagcuggagcccgugcugcugcccaugcccgacaucagaaacguguucuaccacuacaaccagaacaacagccccaagcugagacugguggccaugcuguacaccccccugagagccaacaacagcggcgacgacguguucaccgugagcugcagagugcugaccagacccagccccgacuuccaguucaccuuccuggugccccccaccguggagagcaagaccaagaacuucacccugcccgugcugagagugagcgagaugaccaacagcagauuccccguggugcuggaccagauguacaccagcagaaacgagaacaucaucgugcagccccagaacggcagaugcaccaccgacggcgagcugcugggcaccaccauccugcagagcgugagcaucugcaacuucaagggcaccaugcaggccaagcugaacgaggagcccagauaccagcugcagcugaccaaccuggacggcagccccaucgaccccaccgacgacaugcccgccccccugggcacccccgacuuccaggccaugcuguacggcguggccagccagagaagcagcaccgacaacgccaccagagcccacgacgcccagaucgacaccgccggcgacaccuucgcccccaagaucggccaggugagauucaagagcagcagcaacgacuucgaccugcacgaccccaccaaguucacccccaucggcgugaacguggacgaccagcaccccuucagacaguggagccugcccaacuacggcggccaccuggcccugaacaaccaccuggcccccgccgugaccccccuguuccccggcgagcagauccuguucuucagaagcuacauccccagcgccggcggccacaccgacggcgccauggacugccugcugccccaggaguggguggagcacuucuaccaggaggccgcccccagccagagcgacaucgcccuggugagauucaucaaccccgacaccggcagagugcuguucgaggccaagcugcacaagcagggcuuccugaccaucgccgccagcggcgaccaccccaucgugaugcccaccaacggcuacuucagauucgaggccugggugaaccccuucuacacccuggcccccgugggcaccggcagcggcagaagaagaauccaguga

SEQ ID NO: 23508 - RNA, 1647 nt, Artificial Sequence
  derived and/or modified sequence opt4 from capsid__Norovirus__ACY00629
augaagauggccagcaucgacgccgcccccagcaacgacggcgccgccggccuggugcccgagaucaacaacgaggccauggcccuggaccccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuucgccggcggcuucgaggugcagguggugcuggccggcaacgccuucaccgccggcaagaucaucuucgccgccaucccccccaacuuccccaucgacaaccugagcgccgcccagaucaccaugugcccccacgugaucguggacgugagacagcuggagcccgugaaccugcccaugcccgacgugagaaacaacuucuuccacuacaaccagggcagcgacagcaagcugagacugguggccaugcuguacaccccccugagagccaacaacagcggcgacgacguguucaccgugagcugcagagugcugaccagacccagccccgacuucagcuucaacuuccuggugccccccaccguggagagcaagaccaagcccuucacccugcccauccugaccaucagcgagaugagcaacagcagauuccccgugcccaucgacagccugcacaccagccccaccgagaacaucguggugcagugccagaacggcagagugacccuggacggcgagcugaugggcaccacccagcugcugcccagccagaucugcgccuucagaggcgugcugaccagaagcaccagcagagccagcgaccaggccgacaccgccacccccagacuguucaacuacuacuggcacauccagcuggacaaccugaacggcacccccuacgaccccgccgaggacauccccggcccccugggcacccccgacuucagaggcaagguguucggcguggccagccagagaaaccccgacagcaccaccagagcccacgaggccaagguggacaccaccgccggcagauucacccccaagcugggcagccuggagaucagcaccgagagcgacgacuucgaccagaaccagcccaccagauucacccccgugggcaucggcguggaccacgaggccgacuuccagcaguggagccugcccgacuacagcggccaguucacccacaacaugaaccuggcccccgccguggcccccaacuuccccggcgagcagcugcuguucuucagaagccagcugcccagcagcggcggcagaagcaacggcauccuggacugccuggugccccaggagugggugcagcacuucuaccaggagagcgcccccgcccagacccagguggcccuggugagauacgugaaccccgacaccggcagagugcuguucgaggccaagcugcacaagcugggcuucaugaccaucgccaagaacggcgacagccccaucaccgugccccccaacggcuacuucagauucgagagcugggugaaccccuucuacacccuggugcccaugggcaccggcaacggcagaagaagaauccaguga

SEQ ID NO: 23509 - RNA, 1614 nt, Artificial Sequence
  derived and/or modified sequence opt4 from capsid__Norovirus__ACY00632
auggccagcaacgacgccgcccccagcaacgacggcgccaccggccuggugcccgagaucaacaccgagacccugccccuggagcccguggccggcgccgccaucgccgcccccgugaccggccagaacaacaucaucgaccccuggaucagaaacaacuucgugcaggcccccaacggcgaguucaccgugagccccagaaacagccccggcgagauccugaugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggacaugcugagccccgcccagaucaccaugcugccccaccugaucguggacgugagaacccuggagcccaucaugaucccccugcccgacgugagaaacguguucuaccacuucaacaaccagcccgcccccagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucacccugcccauccugaccaucggcgagcugaccaacagcagauuccccgcccccaucgaccagcuguacaccagccccaacgccgacaucguggugcagccccagaacggcagaugcacccuggacggcgagcugcagggcaccacccagcugcugaccaccgccaucugcagcuacagaggcaugaccagcaaccccaccagcgacuacugggacgaccaccugcugcaccuggugcaccccaacggcgccaccuacgaccccaccgaggacgugcccgcccccuucggcacccaggacuucagaggcauccuguacggcaugcugacccagaaccccagaaccagcggcgacgaggccgccaacagccacggcaucuacaucagcagcaccagcgagaaguucacccccaagcugggcaccaucggccugcaccaggugcagggcagacacagccagcaccagcagagcaaguucacccccgugggcaucgccgugaacggcaacacccccuucagacagugggagcugcccaacuacagcggcgcccugacccugaacaccaaccuggcccccgccgugggccccaacuuccccggcgagcagauccuguucuucagaagcaacgugcccagcgugcagggcggccagcccaucgagaucgacugccugaucccccaggagugggugagccacuucuaccaggagagcgcccccagccagagcgacguggcccuggugagauacgugaaccccgacaccggcagaaccaucuucgaggccaagcugcacagacagggcuucaucaccaucgccgccaccggcagcaaccccgugguggugccccccaacggcuacuucagauucgacagcugggugaaccaguucuacgcccuggcccccaugggcaccggcaacggcagaagaagagugcaguga

SEQ ID NO: 23510 - RNA, 1617 nt, Artificial Sequence
  derived and/or modified sequence opt4 from capsid__Norovirus__ACY00635
augaagauggccagcaacgacgccgcccccagcaacgacggcgccgccggccuggugcccgagaucaacaacgaggugauggcccuggagcccguggccggcggcgccaucgccgccccccugaccggccagaccaacgugaucgaccccuggaucagaaccaacuucgugcaggcccccaacggcgaguucaccaucagccccagaaacagccccggcgaggugcugcugaacauggagcugggccccgagcugaaccccuuccugggccaccugagcagaauguacaacggcuacgccggcggcaucgaggugcaggugcugauggccggcaacgccuucaccgccggcaaggugaucuucgccgccgugcccccccacuuccccguggagaaccugagccccccccaggugaccauguucccccacgugaucguggacgugagaacccuggagcccauccugcugccccugcccgacgugagaaaccaguucuuccacuacagccagguggacgagcccaagaugagacugguggccaugcuguacaccccccugagaagcaacggcagcgccgaggacguguucaccgugagcugcagagugcugaccagacccagccccgacuucgaguucaacuaccuggugccccccaccguggagagcagaaccaagcccuucaccgugcccauccugaccaucggcgagaugagcaacagcagauuccccgcccccaucgacgugaucuacaccagccccaacgacaaccagaacgugcagccccagaacggcagaugcacccuggacggcgagcugcagggcaccacccagcuggugcccagcggcgugugcgccuucagaggcagaaucaccagccacgagggcagcgagcagaaccaguggcacaugcagcugaccaaccugaacggcacccccuucgaccccaccgaggacauccccgccccccugggcacccccgacuucaagggcgagaucuucggcuucaucagccagagaaacgcccagaacgaccccggccagagccagcccgccaacagagcccacgacgccguggugagcaccagagcccccaaguucacccccaagcugggcagcgugaugaucggcaccugggugaacagcgacaucgagaaccagcccagcaaguucacccccgugggccugaacagcagcgagaacuucaagcagugggagcugcccgacuacagcggcgugcugacccugaacaugggccuggcccccguggugcaccccaccuaccccggcgagcagauccuguucuucagaagcuacaucccccugaagggcggccacggcaaccccgccaucgacugccugcugccccaggaguggauccagcacuucuaccaggagagcgcccccagccagaccgacguggcccugcugaaccccgacaccggcagagugcuguucgaggccaagcugcacagacagggcuacaucaccaucgccaagagcggcgacggccccaucguggugccccccaacggcuacuucagauucgacagcugggugaaccaguucuacagccuggcccccaugggcaacggcaacggcagaagaagagugcaguga

SEQ ID NO: 23511 - RNA, 1632 nt, Artificial Sequence
  derived and/or modified sequence opt4 from capsid__Norovirus__ACY00638
augaugauggccagcaaggacgcccccaccaacauggacggcaccagcggcgccggccagcuggugcccgaggugagcaccgccgagcccaucagcauggagcccguggccggcgccgccaccgccgccgccaccgccggccaggugaacaugaucgaccccuggaucaugagcaacuacgugcaggccccccagggcgaguucaccaucagccccaacaacacccccggcgacauccuguucgaccugcagcugggcccccaccugaaccccuuccugagccaccuggcccagauguacaacggcugggugggcaacaugaaggugagagugcugcuggccggcaacgccuucaccgccggcaagaucaucaucagcugcgugccccccggcuucgccgcccagaacgugagcaucgcccaggccaccauguucccccacgugaucgccgacgugagagugcuggagcccaucgaggugccccuggaggacgugagaaacgugcuguuccacaacaacgacagcacccccaccaugagacugaucugcaugcuguacaccccccugagagccagcggcagcagcagcggcaccgaccccuucgugaucgccggcagagugcugaccugccccagccccgacuucaacuuccuguuccuggugccccccaacguggagcagaagaccaagcccuucagcgugcccgaccugccccugaacgugcugagcaacagcagagugcccagccugaucaagagcaugauggugagccaggaccacggccagauggugcaguuccagaacggcagagugacccuggacggccagcugcagggcaccacccccaccagcgccagccagcugugcaagaucagaggcaccguguaccacgccaccggcggccagggccugaaccugaccgagaucgacggcacccccuaccacgccuucgagagccccgcccccaucggcuuccccgaccugggcgagugcgacuggcacaucaacgccagccccgccaacgccuucaccgacggcagcaucauccacagaaucgacguggugcaggaccccaccuucgccccccaccugggcaccauccacuacaccaacgccaacuacgacgccaacgugagccugaucugcagccuggaguggcugagcccccccagcggcggcgcccugaaggccaaccccugggccauccccagauacggcagcacccugaccgaggccgcccagcuggccccccccaucuacccccccggcuucggcgaggccaucguguucuucaugagcgacuuccccaucgccaacggcagcgacggccugagcgugcccugcaccaucccccaggaguucgugacccacuucgugaacgagcaggcccccaccagaggcgaggccgcccugcugcacuacguggaccccgacacccacagaaaccugggcgaguucaagcuguaccccgagggcuucaugaccugcgugcccaacagcagcggcagcggcccccagacccugcccaucaacggcguguucaccuucaucagcugggugagcagauucuaccagcugaagcccgugggcaccaccggccccgugagaagacugggcaucagaagaagcuga

SEQ ID NO: 23512 - RNA, 1635 nt, Artificial Sequence
  derived and/or modified sequence opt4 from capsid__Norovirus__ACY00641
augaugauggccagcaaggacgcccccaccaacauggacggcaccagcggcgccggccagcuggugcccgaggccaacaccgccgagcccaucagcauggaccccguggccggcgccgccaccgccguggccaccgccggccagaucaacaugaucgaccccuggaucaugagcaacuucgugcaggccccccagggcgaguucaccgugagccccaacaacacccccggcgacgugcuguucgaccugcagcugggcccccagcugaaccccuuccuggcccaccuggcccagauguacaacggcugggugggcaacaugagagugaaggugcugcuggccggcaacgccuucaccgccggcaagaucaucaucagcugcaucccccccggcuucaccagccagaacaucagcaucgcccagaugaccauguucccccacgugaucgccgacgugagagugcuggagcccaucgagaucccccuggaggacgugagaaacgugcuguuccacaccaacgacaacagacccaccaugagacuggugugcaugcuguacaccccccugagagccaacggcagcagcagcggcaccgaccccuucgugaucgccggcagagugcugaccugccccgacagcaacuucagcuuccuguuccuggugccccccaacguggagcagaagaccagacccuucagcgugcccaacaucccccugaacacccugagcaacagcagagugcccagccugaucaagagcaugaccaucagcagagaccagaaccagaucauccaguuccagaacggcagagugacccuggacggccagcugcagggcaccacccccaccagcgugagccagcugugcaagaucagaggcaccaccuaccacgccaccggcggcagcggcaucaaccugaccgagcugaacggcgagcccuaccacgccuucgagagccccgcccccaucggcuuccccgaccugggcggcugcgacuggcaccugaccgccacccccacccaggccuucaacgacggcgccaagguggugagacugagcgugacccagggcgccgccuucgccccccaccugggcaccauccacuacaccaccaccgacaccgacuacaaccccaacaccagcaucaucugcacccuggacuggcugagccagaccaccggccagagcaacguggaccccuggcagauccccaccuacggcagcacccugaccgaggccgcccagcuggccccccccaucuucccccccggcuucggcgagacccugguguucuuccugagcgacuuccccaucagcaacggcaagaacggccugagcgugcccugcacccugccccaggaguucgugacccacuucgugaacgagcaggcccccaucagaggcgaggccgcccugcugcacuacgccgaccccgacacccacagaaaccugggcgaguucaagcuguaccccgagggcuucaugaccugcgugcccaacaccagcggcggcggcccccagacccugcccaucaacggcguguucguguucgugagcugggugagcagauucuaccagcugaagcccgugggcaccgccggcgccgccagaagacugggcaucagaagaagcuga

SEQ ID NO: 23513 - RNA, 1635 nt, Artificial Sequence
  derived and/or modified sequence opt4 from capsid__Norovirus__ACY00645
augaugauggccagcaaggacgcccccaccaacauggacggcaccagcggcgccggccagcuggugcccgaggccaacaccgccgagcccaucagcauggaccccguggccggcgccgccaccgccguggccaccgccggccagaucaacaugaucgaccccuggaucaugagcaacuucgugcaggccccccagggcgaguucaccgugagccccaacaacacccccggcgacgugcuguucgaccugcagcugggcccccagcugaaccccuuccuggcccaccuggcccagauguacaacggcugggugggcaacaugagagugaaggugcugcuggccggcaacgccuucaccgccggcaagaucaucaucagcugcaucccccccggcuucaccagccagaacaucagcaucgcccagaugaccauguucccccacgugaucgccgacgugagagugcuggagcccaucgagaucccccuggaggacgugagaaacgugcuguuccacaccaacgacaacagacccaccaugagacuggugugcaugcuguacaccccccugagagccaacggcagcagcagcggcaccgaccccuucgugaucgccggcagagugcugaccugccccgacagcaacuucagcuuccuguuccuggugccccccaacguggagcagaagaccagacccuucagcgugcccaacaucccccugaacacccugagcaacagcagagugcccagccugaucaagagcaugaccaucagcagagaccagaaccagaucauccaguuccagaacggcagagugacccuggacggccagcugcagggcaccacccccaccagcgugagccagcugugcaagaucagaggcaccaccuaccacgccaccggcggcagcggcaucaaccugaccgagcugaacggcgagcccuaccacgccuucgagagccccgcccccaucggcuuccccgaccugggcggcugcgacuggcaccugaccgccacccccacccaggccuucaacgacggcgccaagguggugagacugagcgugacccagggcgccgccuucgccccccaccugggcaccauccacuacaccaccaccgacaccgacuacaaccccaacaccagcaucaucugcacccuggacuggcugagccagaccaccggccagagcaacguggaccccuggcagauccccaccuacggcagcgcccugaccgaggccgcccagcuggccccccccaucuucccccccggcuucggcgagacccugguguucuuccugagcgacuuccccaucagcaacggcaagaacggccugagcgugcccugcacccugccccaggaguucgugacccacuucgugaacgagcaggcccccaucagaggcgaggccgcccugcugcacuacguggaccccgacacccacagaaaccugggcgaguucaagcuguaccccgagggcuucaugaccugcgugcccaacaccagcggcggcggcccccagacccugcccaucaacggcguguucguguucgugagcugggugagcagauucuaccagcugaagcccgugggcaccgccggcgccgccagaagacugggcaucagaagaagcuga

SEQ ID NO: 23514 - RNA, 1635 nt, Artificial Sequence
  derived and/or modified sequence opt4 from capsid__Norovirus__ACY00647
augaugauggccagcaaggacgcccccaccaacauggacggcaccagcggcgccggccagcuggugcccgaggccaacaccgccgagcccaucagcauggagcccguggccggcgccgccaccgccgccgccaccgccggccaggugaacaugaucgaccccuggaucaugaacaacuacgugcaggccccccagggcgaguucaccaucagccccaacaacacccccggcgacauccuguucgaccugcagcugggcccccaccugaaccccuuccugagccaccuggcccagauguacaacggcugggugggcaacaugaaggugaaggugcugcuggccggcaacgccuucaccgccggcaagaucaucaucagcugcaucccccccggcuucgccgcccagaacaucagcaucgcccaggccaccauguucccccacgugaucgccgacgugagagugcuggagcccaucgaggugccccuggaggacgugagaaacgugcuguuccacaacaacgacaacagccccaccaugagacuggugugcaugcuguacaccccccugagagccagcggcagcagcagcggcaccgaccccuucgugaucgccggcagagugcugaccugccccagccccgacuucagcuuccuguuccuggugccccccaacguggagcagaagaccaagcccuucagcgugcccaaccugccccugaacacccugagcaacagcagagugcccagccugaucaacgccaugaugaucagcagagaccacggccagauggugcaguuccagaacggcagagugacccuggacggccagcugcagggcaccacccccaccagccugagccagcugugcaagaucagaggcaagguguuccacgccagcggcggcaacggccugaaccugaccgagcuggacggcagcgccuaccacgccuucgagagccccgcccccaucggcuuccccgacaucggcgagugcgacuggcacaugaacgccaccgccaccagcaacuucaccggcagcaacgacgaguaccagauccuggugaagcaggagagcaccuucgccccccaccugggccacgugcaggccgacagccugagcgccgacgccaacaccgaccugauggugagccugagcuggaucagccccgugagcgaccagcacagaagagacguggaccccugggugauccccagauacggcagcagccugaccgaggccgcccagcuggccccccccaucuacccccccggcuucggcgaggccaucguguucuucaugagcgacuuccccguggugagcggcgugaacggcaugagaauccccugcacccugccccaggaguacguggcccacuucgugaacgagcaggcccccaccagaggcgaggccgcccugcugcacuacguggaccccgacacccacagaaaccugggcgaguucaagauguaccccgagggcuucaugaccugcgugcccaacagcagcggcagcggcccccagacccugcccaucaacggcgugcugaccuucgugagcugggugagcagauucuaccagcugaagcccgugggcaccgccggccccgccagaagacugggcaucagaagaagcuga

SEQ ID NO: 23515 - RNA, 1668 nt, Artificial Sequence
  derived and/or modified sequence opt4 from capsid__Norovirus__ACY00650
augagaauggccagcagcgacgcccccgugagcggcaccgacggcgccgccggccuggugcccgagagccagcaggaggugcugccccuggagcccguggccggcgugcagcuggccgcccccguggccggccagagcaacaucaucgaccccuggaucagaaugaacuucgugcaggcccccgccggcgaguucaccgugagccccagagacgcccccggcgaggugcugaucgaccuggagcugggccccgagcugaaccccuaccugaaccaccuggccagaauguacaacggcuacgugggcggcauggagguggagguggugcuggccggcaacgccuucaccgccggcaagauccuguucgccgccgugccccccagcuuccccacccacggcaucagcgccgcccaggccaccaugcugccccacgugaucguggacgugagacagcuggagcccgugagacugccccugcccgacgugagaaacgugauguuccacuucugccaggagaacaaggagcccagaaugagaaucguggccauccuguacaccccccugagagccaacggcgccggcgacgacguguucaccgugagcugcagagugcugaccagacccagccccgacuucgacuucaucuuccuggugcugcccagcguggagagcaagcugaagcaguucacccugcccaaccugcagcccaacgagaugaccaacagcagauuccccaccggcaucauccagcuguacaccagccccaacaccaaccugguggugcaguuccagaacggcagaugccugcuggacggcacccugcugggcaccacccccgugagagccgccgacaucugcagcuucagaggcgugaccagcaccgagguggacgccaccgacagccccagaguggccggcagccacagaaucauggugcagcugaaggagcccgacggcgaggaguucagccccaccggccccaaccccgcccccgugggcacccccgacuuccaggccgccaucuucggcacccugagccagagaaacaccggcggcgccggccagaacagcaacagagccagauucgccuacuucuacaccagaaaccccaccuucgcccccggcaucggcaccgugguguucagcuucgacaccaccgacuuccagaacagacagcccaccaaguucagccccagcggcguguucgacgacgacagcagcgagcccuucaaccaguucagccugcccuacuacaacggcagccugggcgccguggacgccggcaagcuggccccccccguggcccccaacuaccccggcgagcagauccuguacuucagaggcaacauccccuucaagggcggcuacggcgagggcgagaucgacagccugcugccccaggaguggaucacccacuucuacgccgagcaggcccccacccagggcgacgccgcccugcugagauacuacaaccccgacaccggcagagugcuguucgagugcaagcugcacagagagggcuucaucaccaucaacuacaccggcagcaacgcccuggccgugcccgugaacggcguguucagauucgagggcugggugaacaaguucuacacccugacccccaugggcaacggcaacggcagaagaggcagaagaagagagcuguga

SEQ ID NO: 23516 - RNA, 1617 nt, Artificial Sequence
  derived and/or modified sequence opt4 from capsid__Norovirus__ACY00656
auggccagcaacgacgccgcccccagcaacgacggcgccgccggccuggugcccgaggugaacaacgagaccauggcccuggagcccguggccggcgccagcaucgccgccccccugaccggccagaacaacgugaucgaccccuggaucagacugaacuucgugcaggcccccaacggcgaguucaccgugagccccagaaacagccccggcgagauccugcugaaccuggagcugggccccgagcugaaccccuaccuggcccaccugagcagaauguacaacggcuacgccggcggcguggaggugcaggugcugcuggccggcaacgccuucaccgccggcaagcugguguucgccgccauccccccccacuuccccguggacaaccugagccccggccagaucaccauguucccccacgugaucaucgacgugagaacccuggagcccgugcugcugccccugcccgacgugagaaacaacuucuuccacuacaaccagcagagcgaccagagaaugagacugguggccaugcuguacaccccccugagaagcaacggcagcggcgacgacguguucaccgugagcugcagagugcugaccagacccagccccgacuucgacuucaacuaccuggugccccccaccguggagagcaagaccaagcccuucagcgugcccgugcugacccugaacgagcugaccaacagcagauuccccgugcccaucgacgccauguacaccagccccaacgacagcaucguggugcagccccagaacggcagagccaccaucgacggcgagcugcugggcaccacccagcugauccccagcggcaucugcagcuucagaggcaagaucaccacccaccuggccgacgacagacaccuguggaacauccaggugagcaaccugaacggcacccccuucgaccccaccgacgacgugcccgccccccugggcaugcccgacuucagcggccagaucuucggcguggugagccagagagacaccggcaccaaccccgccaacagagcccacgacgccgugcuggccaccuacagcgccaaguacacccccaagcugggcagcgugcagaucggcaccugggacaccgaggaccugcuggagagacagcccgugaaguucacccccgugggccugaacgagaucggccaggacaagcacuucgaccagugggugcugcccaacuacagcggcgcccugggccugaacaugcaccuggcccccgccgugagcccccuguuccccggcgagagacugcuguucuucagaagcuacaucccccugaagggcggccacggcgaccccuucaucgacugccuggugccccaggaguggauccagcacuucuaccaggagagcgcccccgcccagagcagcguggcccugcugagauacgugaaccccgacaccggcagaacccuguucgaggccaagcugcacaagggcggcuucaucaccgugagcagcaccgagaacagacccgugaucgugccccccaacggcuacuucagauucgacagcugggugaaccaguucuacagccuggcccccaugggcaccggcaacggcagaagaagaaugcaguga

SEQ ID NO: 23517 - RNA, 1623 nt, Artificial Sequence
  derived and/or modified sequence opt4 from capsid__Norovirus__ADK47170
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccugagcagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgccgagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23518 - RNA, 1644 nt, Artificial Sequence
  derived and/or modified sequence opt4 from capsid__Norovirus__ADR30514
augaagauggccagcaacgacgccgcccccagcaacgacggcgccgccgaccuggugcccgaggccaacaacgaggugauggcccuggagcccguggugggcgccagcaucgccgcccccguggugggccagcagaacaucaucgaccccuggaucagagagaacuucgugcaggccccccagggcgaguucaccgugagccccagaaacagccccggcgagaugcugcugaaccuggagcugggccccgagcugaaccccuaccugagccaccugagcagaauguacaacggcuacgccggcggcaugcaggugcagguggugcuggccggcaacgccuucaccgccggcaagaucaucuucgccgccgugcccccccacuuccccguggagaacaucagcgccgcccagaucaccaugugcccccacgugaucguggacgugagacagcuggagcccgugcugcugccccugcccgacaucagaaacagauucuuccacuacaaccaggagaacacccccagaaugagacugguggccaugcuguacaccccccugagagccaacagcggcgaggacguguucaccgugagcugcagagugcugaccagacccgcccccgacuucgaguucaccuuccuggugccccccaccguggagagcaagaccaagcccuucacccugcccauccugacccugggcgagcugagcaacagcagauuccccgcccccaucgacaugcuguacaccgaccccaacgagggcaucguggugcagccccagaacggcagaugcacccuggacggcacccugcagggcaccacccagcuggugcccacccagaucugcgccuucagaggcacccugaucggccagaccagcagaagcagcgacagcaccgacagcgcccccagaagaagagaccacccccugcacgugcagcugaagaaccuggacggcacccaguacgaccccaccgacgaggugcccgccgugcugggcgccaucgacuucaagggcaccguguucggcguggccagccagagagacgugagcggccagcaggugggcgccaccagagcccacgaggugcacaucaacaccaccgaccccagauacacccccaagcugggcagcauccugaugcacagcgagagcgacgacuucgugaccggccagcccgugagauucacccccaucggcaugggcgacaacgacuggcaccagugggagcugcccgacuacagcggccaccugacccugaacaugagccuggcccccgccguggcccccgccuuccccggcgagagaauccuguucuucagaagcaucgugcccagcgccggcggcuacggcagcggccagaucgacugccugaucccccaggagugggugcagcacuucuaccaggaggccgcccccagccagagcgccguggcccugaucagauacgugaaccccgacaccggcagaaacaucuucgaggccaagcugcacagagagggcuucaucaccguggccaacagcggcaacaaccccaucguggugccccccaacggcuacuucagauucgaggccugggugaaccaguucuacacccugacccccaugggcaccggccagggcagaagaagaaaccaguga

SEQ ID NO: 23519 - RNA, 1623 nt, Artificial Sequence
  derived and/or modified sequence opt4 from capsid__Norovirus__ADR78255
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccacccagaacuggaacagcuacgaccccaccgaggagauccccgccccccugggcacccccgacuucgugggcaagauccagggcgugcugacccagaccaccagagccgacggcagcaccagaggccacaaggccaccguguacaccggcagcgccgacuucagccccaagcugggcagagugcaguucgccaccgacaccgacaacgacuucgacgccaaccagaacaccaaguucacccccgugggcgugauccaggacggcaacaccgcccacagaaacgagccccagcagugggugcugcccagcuacagcggcagaaacagccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23520 - RNA, 1623 nt, Artificial Sequence
  derived and/or modified sequence opt4 from capsid__Norovirus__ADR78259
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccugagcagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23521 - RNA, 1623 nt, Artificial Sequence
  derived and/or modified sequence opt4 from capsid__Norovirus__ADR78262
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccugagcagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23522 - RNA, 1623 nt, Artificial Sequence
  derived and/or modified sequence opt4 from capsid__Norovirus__ADR78266
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccugagcagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23523 - RNA, 1623 nt, Artificial Sequence; identical to SEQ ID NO: 23520
  derived and/or modified sequence opt4 from capsid__Norovirus__ADR78268

SEQ ID NO: 23524 - RNA, 1569 nt, Artificial Sequence
  derived and/or modified sequence opt4 from capsid__Norovirus__AFQ00093
augaagaugaccgacagagacaucguggacagcgcccccgcccugggccaggugcugccccccgagguggaggccagcgugcccguggagcccaccgccggcgcccccguggccgccagcaccgccggcagagugaaccccaucgaccccuggaucuucgccaacuucgugcaggccccccagggcgaguucaccaucagccccaacaacaaccccggcgagauccuguucgagcuggagcugggccccgaccugaaccccuaccuggcccaccugagaagaauguacaacggcuggaccggcagcaugagagugagagugcugcuggccggcaacgccuucagcgccggcaagguggugguguucugcgugccccccggcuucgacaccagcuaccugacccccagccaggccacccaguucccccacgugcugaucgacgugagagcccccgagcccguggacaugccccuggaggacgugagaaacauccuguuccaccagggccccgacagcagaaugagacugaugggcaugcuguacaccccccugagagccaacagcggcgccgaccccuucguggugaccggcagagugcugaccugccccagccccaacuucagcuucuucuuccuggugccccccaccguggaggagagagagccccccuucacccugcccaaccugcccgugaacagccugagccacagcagagugauggagcccaucgcccagaugaugagcagcagaagcuuccccgccagcgugcaguuccagaacggcagaugcacccugagcggcgaccugcugggcaccacccccagcagccccgccgaccugggcgccuucgugggccugaucgccgagcccggcagcagagugguggagcugagccagcccaaccaggaggacuuccacgccggcagcgcccccgcccccuucggcuuccccgacuucagcgagugcagcgugaccuucgugguggccagcgccaccaccgugggcgagagaaccgugaacgccagaaacccccagaacuucacccccgcccugggccacaucaccuucgacgaggaggcccccgccgaccuguucagagccagauucagaaaccugugggagcccaccgagcacagcuucuggagaauccccgacuacagagccgacgugcugggcagcgacuucgcccccagcgugagcgcccccggcgugggcgagacccugcuguucuucaugugcaacgugcccagacugaacggcgccaaccccaaccccugccccugccugcugccccaggaguggaucacccacuucgugagcgagagagccgcccugcagagcgacguggcccugcugaacuacgugaaccccaacaccggcagagugcuguucgaggccaagcuguacgccaacggcuuccugaccgugaaccugggcgccagcgaccaggccauccugcccguggacggcaucuucaaguucgugagcugggugagcuucuacuaccagcugagacccgugggcaacaucagcgugggcagaagacugcccagacuggacggcuucuga

SEQ ID NO: 23525 - RNA, 1629 nt, Artificial Sequence
  derived and/or modified sequence opt4 from capsid__Norovirus__BAI52939
augaagauggccagcaacgacgccgcccccagcaccgacggcgccgccggccuggugcccgagagcaacaacgaggugauggcccuggagcccguggccggcgccgcccuggccgcccccgugaccggccagaccaacaucaucgaccccuggaucagagccaacuucgugcaggcccccaacggcgaguucaccgugagccccagaaacgcccccggcgaggugcugcugaaccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccaucgagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauuccccgccagcaucgaccagauguacaccagccccaacgaggugaucagcgugcagugccagaacggcagaugcacccuggacggcgagcugcagggcaccacccagcugcaggugagcggcaucugcgccuucaagggcgaggugaccgcccaccugcacgacaacgaccaccuguacaacaucaccaucaccaaccugaacggcagccccuucgaccccagcgaggacauccccgccccccugggcaugcccgacuuccagggcagaguguucggcaucaucagccagagagacagacacaacagccccggccacaacgagcccgccaacagaggccacgacgccguggugcccaccuacaccgcccaguacacccccaagcugggccagauccagaucggcaccuggcagaccgacgaccugaccgugagccagcccgugaaguucacccccgugggccugaacgacaccgagcacuucaaccaguggguggugcccagauacgccggcgcccugaaccugaacaccaaccuggcccccagcguggcccccguguuccccggcgagagacugcuguucuucagaagcuacaucccccugaagggcggcuacggcaaccccgccaucgacugccugcugccccaggagugggugcagcacuucuaccaggaggccgcccccagcaugagcgagguggcccuggugagaugcaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagagugcaguga

SEQ ID NO: 23526 - RNA, 1623 nt, Artificial Sequence
  derived and/or modified sequence opt4 from capsid__Norovirus__BAI52940
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugggccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugaccagaaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23527 - RNA, 1623 nt, Artificial Sequence
  derived and/or modified sequence opt4 from capsid__Norovirus__BAQ20801
augaagauggccagcagcgacgccaaccccagcgacggcagcgccgccaaccuggugcccgaggugaacaacgaggacauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccaacuucagccccaagcugggcagagugcaguucgagaccgacaccgaccacgacuucgaggugaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23528 - RNA, 1623 nt, Artificial Sequence
  derived and/or modified sequence opt4 from capsid__Norovirus__BAQ20803
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccaacuucagccccaagcugggcagagugcaguucgagaccgacaccgaccacgacuucgaggugaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23529 - RNA, 1623 nt, Artificial Sequence
  derived and/or modified sequence opt4 from capsid__Norovirus__BAQ20805
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccggcgagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaccaccggcagccacaacuacaccaugaaccuggccagccagaacuggaacaacuacgaccccaccgaggagauccccgccccccugggcacccccgacuucgugggcaagauccagggcaugcugacccagaccaccagaaccgacggcagcaccagaggccacaaggccaccguguacaccggcagcgccgacuucgcccccaagcugggcagagugcaguucggcaccgacaccgaccacgaccuggaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23530 - RNA, 1647 nt, Artificial Sequence
  derived and/or modified sequence opt4 from capsid_protein__Norovirus__AAB06271
augaagauggccagcaacagagccgcccccagcaacgacggcgccgccugccuggugcccgagaucaacaacgaggccauggcccuggagcccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgccuucaccgccgccaagaucaucuucgccgccaucccccccaacuuccccaucgacaaccugagcgccgcccagaucaccaugugcccccacgugaucguggacgugagacagcuggagcccaucaaccugcccaugcccgacgugagaaacaacuucuuccacuacaaccagggcagcgacagcagacugagacugaucgccaugcuguacaccccccugagagccaacaacagcggcgacgacguguucaccgugagcugcagagugcugaccagacccagccccgacuuccuguucaacuuccuggugccccccaccguggagagcaagaccaagcccuucacccugcccauccugaccaucagcgagaugagcaacagcagauuccccgugcccaucgacagccugcacaccagccccaccgagaacaucguggugcagugccagaacggcagagugacccuggacggcgagcugaugggcaccacccagcugcugcccagccagaucugcgccuucagaggcacccugaccggcagcaccagcagagccagcgaccaggccgacacccccacccccagacuguucaaccaccacuggcacauccagcuggacaaccugaacggcacccccuacgaccccgccgaggacauccccgccccccugggcacccccgacuucagaggcaagguguucggcguggccggccagagaaaccccgacagcaccaccagagcccacgaggccaagguggacaccaccagcggcagauucacccccaagcugggcagccuggagaucaccaccgagagcgacgaccuggaccugagccagcccaccaaguucacccccgugggcaucggcguggacaacagagccgaguuccagcaguggagccugcccgacuacagcggccaguucacccacaacaugaaccuggcccccgccguggcccccaacuuccccggcgagcagcugcuguucuucagaagccagcugcccagcagcggcggcagaagcaacggcgugcuggacugccuggugccccaggagugggugcagcacuucuaccaggagagcgcccccgcccagacccagguggcccuggugagauacgugaaccccgacaccggcagagugcuguucgaggccaagcugcacaagcugggcuucaugaccguggccaagaacggcgacagccccaucaccgugccccccaacggcuacuucagauucgagagcugggugaaccccuucuacacccuggcccccaugggcaccggcaacggcagaagaagaauccaguga

SEQ ID NO: 23531 - RNA, 1620 nt, Artificial Sequence
  derived and/or modified sequence opt4 from capsid_protein__Norovirus__AAK96218
augaagauggccagcagcgacgccaaccccagcgacggcagcaccgccaaccuggugcccgaggugaacaacgaggugauggcccuggagcccguggugggcgccgccaucgccggccccguggccggccagcagaacgugaucgaccccuggaucagaaacaacuucgugcaggcccccggcggcgaguucaccgugagccccaccaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgccagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccaucccccuggagaagcuguacaccggccccagcagcguguucguggugcagccccagaacggcagaugcaccaccgacggcgugcugcugggcaccacccagcugagcgccgugaacaucugcaccuucagaggcgacgugacccacaucgccggcagccacgacuacaccaugaaccuggccagccagaacuggaacaacuacgaccccaccgaggagauccccgccccccugggcacccccgacuucgugggcaagauccagggcaugcugacccagaccaccagagaggacggcagcaccagagccaccaaggccaccgugagcaccggcagcgugcacuucacccccaagcugggcagcgugcaguacaccgccgacaccaacaacgacuuccagaccggccagaacaccaaguucacccccgugggcgugauccaggacggcagcaaccaccagaacgagccccagcagugggugcugaccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgaccccugggugaaccaguucuacacccuggcccccaugggcaacggcgccggcagaagaagagcccuguga

SEQ ID NO: 23532 - RNA, 1623 nt, Artificial Sequence
  derived and/or modified sequence opt4 from capsid_protein__Norovirus__AAR97648
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcacccacaacuacaccaugaaccuggccagccagaacuggaacaacuacgaccccaccgaggagauccccgccccccugggcacccccgacuucgugggcagaauccagggcaugcugacccagaccaccagaggcgacggcagcaccagaggccacaaggccaccgugagcaccggcgacgugcacuucacccccaagcugggcagcauccaguucaacaccgacaccaacaacgacuucgagaccggccagaacaccaaguucacccccgugggcguggugcaggacggcaacggcacccaccagaacgagccccagcagugggugcugcccagcuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23533 - RNA, 1623 nt, Artificial Sequence
  derived and/or modified sequence opt4 from capsid_protein__Norovirus__AAR97651
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucguguucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccacaacuacaccaugaaccuggccagccagaacuggaacaacuacgaccccaccgaggagauccccgccccccugggcacccccgacuucgugggcagaauccagggcaugcugacccagaccaccagaggcgacggcagcaccagaggccacaaggccaccgugagcaccggcgacgugcacuucacccccaagcugggcagcauccaguucaacaccgacaccaacaacgacuucgagaccggccagaacaccaaguucacccccgugggcguggugcaggacggcaacggcacccaccagaacgagccccagcagugggugcugcccagcuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23534 - RNA, 1623 nt, Artificial Sequence; identical to SEQ ID NO: 23532
  derived and/or modified sequence opt4 from capsid_protein__Norovirus__AAR97654

SEQ ID NO: 23535 - RNA, 1623 nt, Artificial Sequence; identical to SEQ ID NO: 23532
  derived and/or modified sequence opt4 from capsid_protein__Norovirus__AAR97657

SEQ ID NO: 23536 - RNA, 1623 nt, Artificial Sequence; identical to SEQ ID NO: 23532
  derived and/or modified sequence opt4 from capsid_protein__Norovirus__AAR97660

SEQ ID NO: 23537 - RNA, 1623 nt, Artificial Sequence
  derived and/or modified sequence opt4 from capsid_protein__Norovirus__AAR97663
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagcugaacgaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcacccacaacuacaccaugaaccuggccagccagaacuggaacaacuacgaccccaccgaggagauccccgccccccugggcacccccgacuucgugggcagaauccagggcaugcugacccagaccaccagaggcgacggcagcaccagaggccacaaggccaccgugagcaccggcgacgugcacuucacccccaagcugggcagcauccaguucaacaccgacaccaacaacgacuucgagaccggccagaacaccaaguucacccccgugggcguggugcaggacggcaacggcacccaccagaacgagccccagcagugggugcugcccagcuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23538 - RNA, 1623 nt, Artificial Sequence
  derived and/or modified sequence opt4 from capsid_protein__Norovirus__AAS86774
augaagauggccagcaacgacgccgcccccagcaacgacggcgccgccggccuggugcccgaggugaacaacgagaccauggcccuggagcccguggccggcgccagcaucgccgccccccugaccggccagaacaacgugaucgaccccuggaucagacugaacuucgugcaggcccccaacggcgaguucaccgugagccccagaaacagccccggcgagauccugcugaaccuggagcugggccccgagcugaaccccuaccuggcccaccuggccagaauguacaacggcuacgccggcggcguggaggugcaggugcugcuggccggcaacgccuucaccgccggcaagcugguguucgccgccauccccccccacuuccccguggacaaccugagccccggccagaucaccauguucccccacgugaucaucgacgugagaacccuggagcccgugcugcugccccugcccgacgugagaaacaacuucuuccacuacaaccagcagagcgaccagagaaugagacugguggccaugcuguacaccccccugagaagcaacggcagcggcgacgacguguucaccgugagcugcagagugcugaccagacccagccccgacuucgacuucaacuaccuggugccccccaccguggagagcaagaccaagcccuucagcgugcccgugcugacccugaacgagcugaccaacagcagauuccccgugcccguggacgccauguacaccagccccaacgacagcaucguggugcagccccagaacggcagagccaccaucgacggcgagcugcugggcaccacccagcugauccccagcggcaucugcagcuucagaggcaagaucaccacccaccugagcgacgacagacaccuguggaacauccaggugagcaaccugaacggcacccccuucgaccccaccgacgacgugcccgccccccugggcaugcccgacuucagcggccagaucuucggcguggugagccagagagacaccggcaccaaccccgccaacagagcccacgacgccgugcuggccaccuacagcgccaaguacacccccaagcugggcagcgugcagaucggcaccugggacaccgacgaccugcuggagagacagcccgugaaguucacccccgugggccugaacgagaucggccaggacaagcacuucgaccagugggugcugcccaacuacagcggcgcccugggccugaacaugcaccuggcccccgccgugagcccccuguuccccggcgagagacugcuguucuucagaagcuacaucccccugaagggcggccacggcgaccccuucaucgacugccuggugccccaggaguggauccagcacuucuaccaggagagcgcccccgcccagagcagcguggcccugcugagauacgugaaccccgacaccggcagaacccuguucgaggccaagcugcacaaggagggcuucaucaccgugagcagcaccgagaacagacccgugaucgugccccccaacggcuacuucagauucgacagcugggugaaccaguucuacagccuggcccccaugggcaccggcaacggcagaagaagaaugcaguga

SEQ ID NO: 23539 - RNA, 1623 nt, Artificial Sequence
  derived and/or modified sequence opt4 from capsid_protein__Norovirus__AAS86777
augaagauggccagcaacgacgccgcccccagcaacgacggcgccgccggccuggugcccgaggugaacaacgagaccauggcccuggagcccguggccggcgccagcaucgccgccccccugaccggccagaacaacgugaucgaccccuggaucagacugaacuucgugcaggcccccaacggcgaguucaccgugagccccagaaacagccccggcgaggugcugcugaaccuggagcugggccccgagcugaaccccuaccuggcccaccuggccagaauguacaacggcuacgccggcggcguggaggugcaggugcugcuggccggcaacgccuucaccgccggcaagcugguguucgccgccauccccccccacuuccccguggacaaccugagccccggccagaucaccauguucccccacgugaucaucgacgugagaacccuggagcccgugcugcugccccugcccgacgugagaaacaacuucuuccacuacaaccagcagagcgaccagagaaugagacugguggccaugcuguacaccccccugagaagcaacggcagcggcgacgacguguucaccgugagcugcagagugcugaccagacccagccccgacuucgacuucaacuaccuggugccccccaccguggagagcaagaccaagcccuucagcgugcccgugcugacccugaacgagcugaccaacagcagauuccccgugcccaucgacgccauguacaccagccccaacgacagcaucguggugcagccccagaacggcagagccaccaucgacggcgagcugcugggcaccacccagcugauccccagcggcaucugcagcuucagaggcaagaucaccacccaccugagcgacgacagacaccuguggaacauccaggugagcaaccugaacggcacccccuucgaccccaccgacgacgugcccgccccccugggcaugcccgacuucagcggccagaucuucggcguggugagccagagagacaccggcaccaaccccgccaacagagcccacgacgccgugcuggccaccuacagcgccaaguacacccccaagcugggcagcgugcagaucggcaccugggacaccgaggaccugcuggagagacagcccgugaaguucacccccgugggccugaacgagaucggccaggacaagcacuucgaccagugggugcugcccaacuacagcggcgcccugggccugaacaugcaccuggcccccgccgugagcccccuguuccccggcgagagacugcuguucuucagaagcuacaucccccugaagggcggcuacggcgaccccuucaucgacugccuggugccccaggaguggauccagcacuucuaccaggagagcgcccccgcccagagcagcguggcccugcugagauacgugaaccccgacaccggcagaacccuguucgaggccaagcugcacaaggagggcuucaucaccgugagcagcaccgagaacagacccgugaucgugccccccaacggcuacuucagauucgacagcugggugaaccaguucuacagccuggcccccaugggcaccggcaacggcagaagaagaaugcaguga

SEQ ID NO: 23540 - RNA, 1623 nt, Artificial Sequence
  derived and/or modified sequence opt4 from capsid_protein__Norovirus__AAS86780
augaugauggccagcaaggacgcccccaccagccccgacggcgccagcggcgccggccagcuggugcccgaggccaacaccgccgagcagaucagcauggaccccguggccggcgccagcaccgccguggccaccgccggccaggugaacaugaucgaccccuggaucuucaacaacuucgugcaggccccccagggcgaguucaccaucagccccaacaacacccccggcgacauccuguucgaccugcagcugggcccccaccugaaccccuuccuggcccaccugagccagauguacaacggcugggugggcaacaugagagugagaauccugcuggccggcaacgccuucaccgccggcaagaucaucaucugcugcgugccccccggcuucgacgccagaauccugaccaucgcccaggccacccuguucccccaccugaucgccgacgugagaacccuggagcccguggagcugccccuggaggacgugagaaacgugcuguaccacaacagcagccagccccagcccaccaugagacugguggccaugcuguacaccccccugagaaccggcggcggcagcggcggcaccgacgccuucgugguggccggcagagugcugaccugccccgcccccgacuucagcuuccuguuccuggugccccccagcguggagcagaagaccagaguguucagcgugcccaacaucccccugaaggaccugagcaacagcagagugcccgugcccauccagggcauguucaugagccccgacgugaaccagagcgugcaguuccagaacggcagaugccagaucgacggccagcugcagggcaccacccccgugagccugagccagcugugcaagaucagaggcaagaccagcagcaacgccagagugcugaaccugagcgagguggacggcacccccuucgugccccuggagagccccgcccccgugggcuuccccgaccugggcggcugcgacuggcacgugaacuucaccuuccaggcccagaaccaggaccccagccagagcgugaccuucgccaccaacgacgccagcuucgugcccuaccugggcagcaucagcccccacaacggcggcgacuuccacgccggcgacaucaucggcagccugggcuggaucagcgcccccagcgacaacacccagcugaacguguggaccauccccaaguacggcagcagccugcccgacgugacccaccuggcccccgccguguucccccccggcuucggcgaggugauccuguacuucuacagcaccuuccccggcagcggccagcccagccagcugcaggugcccugccugcugccccaggaguucaucacccacuucugcaacgagcaggcccccaucgccggcgaggccgcccugcugcacuacguggaccccgacaccggcagaaaccugggcgaguucaagcuguaccccgacggcuucaugaccugcgugcccaacagcgugagcagcggcccccagacccugcccaucaacggcguguucguguucgugagcugggugagcagauucuaccagcugaagcccgugggcaccgccagcgccgccagaagacugggccugagaagaaucuga

SEQ ID NO: 23541 - RNA, 1623 nt, Artificial Sequence
  derived and/or modified sequence opt4 from capsid_protein__Norovirus__AAS86783
augaugauggccagcaaggacgcccccaccagccccgacggcgccagcggcgccggccagcuggugcccgaggccaacaccgccgagcagaucagcauggaccccguggccggcgccagcaccgccguggccaccgccggccaggugaacaugaucgaccccuggaucuucaacaacuucgugcaggccccccagggcgaguucaccaucagccccaacaacacccccggcgacauccuguucgaccugcagcugggcccccaccugaaccccuuccuggcccaccugagccagauguacaacggcugggugggcaacaugagagugagaauccugcuggccggcaacgccuucaccgccggcaagaucaucaucugcugcgugccccccggcuucgacgccagaauccugaccaucgcccaggccacccuguucccccaccugaucgccgacgugagaacccuggagcccguggagcugccccuggaggacgugagaaacgugcuguuccacaacagcagccagccccagcccaccaugagacugguggccaugcuguacaccccccugagaaccggcggcggcagcggcggcaccgacgccuucgugguggccggcagagugcugaccugccccgcccccgacuucagcuuccuguuccuggugccccccagcguggagcagaagaccagaguguucagcgugcccaacgugccccugaaggaccugagcaacagcagagugcccgugcccauccagggcauguucaugagccccgacgugaaccagagcgugcaguuccagaacggcagaugccagaucgacggccagcugcagggcaccacccccgugagccugagccagcugugcaagaucagaggcaagaccagcagcaacgccagagugcugaaccugagcgagguggacggcagccccuucaucccccuggagagccccgcccccgugggcuuccccgaccugggcggcugcgacuggcacgugaacuucaccuuccaggcccaggaccaggaccccagccagagcgugaccuucgccaccaacgacgccagcuucgugcccuaccugggcagcaucagcccccacaacggcggcgacuuccacagcggcgacaucaucggcagccugggcuggaucagcgcccccagcgacagcagccagcugaacguguggaccauccccaaguacggcagcagccugcccgacgugacccaccuggcccccgccguguucccccccggcuucggcgaggugauccuguacuucuacagcaccuuccccggcagcggccagcccgugcagcugcaggugcccugccugcugccccaggaguucaucacccacuucugcaacgagcaggcccccaucgccggcgaggccgcccugcugcacuacguggaccccgacaccggcagaaaccugggcgaguucaagcuguaccccgacggcuucaugaccugcgugcccaacagcgugagcagcggcccccagacccugcccaucaacggcguguucguguucgugagcugggugagcagauucuaccagcugaagcccgugggcaccgccagcguggccagaagacugggccugagaagaaucuga

SEQ ID NO: 23542 - RNA, 1623 nt, Artificial Sequence
  derived and/or modified sequence opt4 from capsid_protein__Norovirus__AAS86786
augaagauggccagcaacgacgccgcccccagcaacgacggcgccaccggccuggugcccgagaucaacaacgagacccugccccuggagcccguggccggcgccgccaucgccgcccccgugaccggccagaacaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacaacaaccagcccgccaacagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucagccugcccauccugaccaucagcgagcugaccaacagcagauuccccgcccccaucgacagccuguucaccgcccagaacaacaaccugaacgugcagugccagaacggcagaugcacccuggacggcgagcugcagggcaccacccagcugcugcccagcggcaucugcgccuucagaggcagacugaccgccgacguggacggcagccacgacgacagauggcacaugcagcugaccaaccugaacggcacccccuucgaccccaccgaggacgugcccgccccccugggcacccccgacuucaccggccugcuguucggcguggccagccagagaaacgugggcagcaaccccaacaccaccagagcccacgaggccguggugagcaccaccagcagccaguucgugcccaagcugggcagcgugaacuucggcagcaccagcaccgacuuccagcugcagcagcccaccaaguucacccccgugggcaucaagaucgagagcggccacgaguucgaccagugggcccugcccagauacagcggccaccugacccugaacaugaaccuggccccccccaucgcccccaacuuccccggcgagcagcugcuguucuucagaagcaacgugcccugcgccggcggcgugagcgacggcgugaucgacugccugcugccccaggaguggauccagcacuucuaccaggagagcgcccccagccagagcgacguggcccugaucagauacgugaaccccgacaccggcagaacccuguucgaggccaagcugcacagaaccggcuacaucaccguggcccacagcggcgacuacccccugguggugcccagcaacggcuacuucagauucgacagcugggugaaccaguucuacagccuggcccccaugggcaccggcaacggcagaagaagagugcaguga

SEQ ID NO: 23543 - RNA, 1623 nt, Artificial Sequence
  derived and/or modified sequence opt4 from capsid_protein__Norovirus__AAS86792
augaagauggccagcaacgacgccgcccccagcaacgacggcgccgccggccuggugcccgaggugaacaacgagaccauggcccuggagcccguggccggcgccagcaucgccgccccccugaccggccagaacaacgugaucgaccccuggaucagacugaacuucgugcaggcccccaacggcgaguucaccgugagccccagaaacagccccggcgagauccugcugaaccuggagcugggccccgagcugaaccccuaccuggcccaccuggccagaauguacaacggcuacgccggcggcguggaggugcaggugcugcuggccggcaacgccuucaccgccggcaagcugguguucgccgccauccccccccacuuccccguggacaaccugagccccggccagaucaccauguucccccacgugaucaucgacgugagaacccuggagcccgugcugcugccccugcccgacgugagaaacaacuucuuccacuacaaccagcagagcgaccagagaaugagacugaucgccaugcuguacaccccccugagaagcaacggcagcggcgacgacguguucaccgugagcugcagagugcugaccagacccagccccgacuucgacuucaacuaccuggugccccccaccguggagagcaagaccaagcccuucagcgugcccgugcugacccugaacgagcugaccaacagcagauuccccgugcccaucgacgccauguacaccagccccaacgacagcaucguggugcagccccagaacggcagagccaccaucgacggcgagcugcugggcaccacccagcugauccccagcggcaucugcagcuucagaggcaagaucaccacccaccugagcgacgacagacaccuguggaacgugcaggugagcaaccugaacggcacccccuucgaccccaccgacgacgugcccgccccccugggcaugcccgacuucagcggccagaucuucggcguggugagccagagagacaccggcaccaaccccgccaacagagcccacgacgccgugcuggccaccuacagcgccaaguacacccccaagcugggcagcgugcagaucggcaccugggacaccgaggaccugcuggagagacagcccgugaaguucacccccgugggccugaacgagaucggccaggacaagcacuucgaccagugggugcugcccaacuacagcggcgcccugggccugaacaugcaccuggcccccgccgugagcccccuguuccccggcgagagacugcuguucuucagaagcuacaucccccugaagggcggccacggcgaccccuucaucgacugccuggugccccaggaguggauccagcacuucuaccaggagagcgcccccgcccagagcagcguggcccugcugagauacgugaaccccgacaccggcagaacccuguucgaggccaagcugcacaaggagggcuucaucaccgugagcagcaccgagaacagacccgugaucgugccccccaacggcuacuucagauucgacagcugggugaaccaguucuacagccuggcccccaugggcaccggcaacggcagaagaagaaugcaguga

SEQ ID NO: 23544 - RNA, 1623 nt, Artificial Sequence
  derived and/or modified sequence opt4 from capsid_protein__Norovirus__AAS86795
augaagauggccagcaacgacgccgcccccagcaacgacggcgccgccggccuggugcccgaggugaacaacgagaccauggcccuggagcccguggccggcgccagcaucgccgccccccugaccggccagaacaacgugaucgaccccuggaucagacugaacuucgugcaggcccccaacggcgaguucaccgugagccccagaaacagccccggcgagauccugcugaaccuggagcugggccccgagcugaaccccuaccuggcccaccuggccagaauguacaacggcuacgccggcggcguggaggugcaggugcugcuggccggcaacgccuucaccgccggcaagcugguguucgccgccauccccccccacuuccccguggacaaccugagccccggccagaucaccauguucccccacgugaucaucgacgugagaacccuggagcccgugcugcugccccugcccgacgugagaaacaacuucuuccacuacaaccagcagagcgaccagagaaugagacugguggccaugcuguacaccccccugagaagcaacggcagcggcgacgacguguucaccgugagcugcagagugcugaccagacccagccccgacuucgacuucaacuaccuggugccccccaccguggagagcaagaccaagcccuucagcgugcccgugcugacccugaacgagcugaccaacagcagauuccccgugcccaucgacgccauguacaccagccccaacgacagcaucguggugcagccccagaacggcagagccaccaucgacggcgagcugcugggcaccacccagcugauccccagcggcaucugcagcuucagaggcaagaucaccacccaccugagcgacgacagacaccuguggaacauccaggugagcaaccugaacggcacccccuucgaccccaccgacgacgugcccgccccccugggcaugcccgacuucagcggccagaucuucggcguggugagccagagagacaccggcaccaaccccgccaacagagcccacgacgccgugcuggccaccuacagcgccaaguacacccccaagcugggcagcgugcagaucggcaccugggacaccgaggaccugcuggagagacagcccgugaaguucacccccgugggccugaacgagaucggccaggacaagcacuucgaccagugggugcugcccaacuacagcggcgcccugggccugaacaugcaccuggcccccgccgugagcccccuguuccccggcgagagacugcuguucuucagaagcuacaucccccugaagggcggccacggcgaccccuucaucgacugccuggugccccaggaguggauccagcacuucuaccaggagagcgcccccgcccagagcagcguggcccugcugagauacgugaaccccgacaccggcagaacccuguucgaggccaagcugcacaaggagggcuucaucaccgugagcagcaccgagaacagacccgugaucgugccccccaacggcuacuucagauucgacagcugggugaaccaguucuacagccuggcccccaugggcaccggcaacggcagaagaagaaugcaguga

SEQ ID NO: 23545 - RNA, 1623 nt, Artificial Sequence
  derived and/or modified sequence opt4 from capsid_protein__Norovirus__AAS86798
augaagauggccagcaacgacgccgcccccagcaacgacggcgccgccggccuggugcccgaggugaacaacgagaccauggcccuggagcccguggccggcgccagcaucgccgccccccugaccggccagaacaacgugaucgaccccuggaucagacugaacuucgugcaggcccccaacggcgaguucaccgugagccccagaaacagccccggcgagauccugcugaaccuggagcugggccccgagcugaaccccuaccuggcccaccuggccagaauguacaacggcuacgccggcggcguggaggugcaggugcugcuggccggcaacgccuucaccgccggcaagcugguguucgccgccauccccccccacuuccccguggacaaccugagccccggccagaucaccauguucccccacgugaucaucgacgugagaacccuggagcccgugcugcugccccugcccgacgugagaaacaacuucuuccacuacagccagcagagcgaccagagaaugagacugguggccaugcuguacaccccccugagaagcaacggcagcggcgacgacguguucaccgugagcugcagagugcugaccagacccagccccgacuucgacuucaacuaccuggugccccccaccguggagagcaagaccaagcccuucagcgugcccgugcugacccugaacgagcugaccaacagcagauuccccgugcccaucgacgccauguacaccagccccaacgacagcaucguggugcagccccagaacggcagagccaccaucgacggcgagcugcugggcaccacccagcugauccccagcggcaucugcagcuucagaggcaagaucaccacccaccugagcgacgacagacaccuguggaacauccaggugagcaaccugaacggcacccccuucgaccccaccgacgacgugcccgccccccugggcaugcccgacuucagcggccagaucuucggcguggugagccagagagacaccggcaccaaccccgccaacagagcccacgacgccgugcuggccaccuacagcgccaaguacacccccaagcugggcagcgugcagaucggcaccugggacaccgaggaccugcuggagagacagcccgugaaguucacccccgugggccugaacgagaucggccaggacaagcacuucgaccagugggugcugcccaacuacagcggcgcccugggccugaacaugcaccuggcccccgccgugagcccccuguuccccggcgagagacugcuguucuucagaagcuacaucccccugaagggcggccacggcgaccccuucaucgacugccuggugccccaggaguggauccagcacuucuaccaggagagcgcccccgcccagagcagcguggcccugcugagauacgugaaccccgacaccggcagaacccuguucgaggccaagcugcacaaggagggcuucaucaccgugagcagcaccgagaacagacccgugaucgugccccccaacggcuacuucagauucgacagcugggugaaccaguucuacagccuggcccccaugggcaccggcaacggcagaagaagaaugcaguga

SEQ ID NO: 23546 - RNA, 1623 nt, Artificial Sequence; identical to SEQ ID NO: 23544
  derived and/or modified sequence opt4 from capsid_protein__Norovirus__AAS86801

SEQ ID NO: 23547 - RNA, 1623 nt, Artificial Sequence
  derived and/or modified sequence opt4 from capsid_protein__Norovirus__AAS86804
augaagauggccagcaacgacgccgcccccagcaacgacggcgccgccggccuggugcccgaggugaacaacgagaccauggcccuggagcccguggccggcgccagcaucgccgccccccugaccggccagaacaacgugaucgaccccuggaucagacugaacuucgugcaggcccccaacggcgaguucaccgugagccccagaaacagccccggcgaggugcugcugaaccuggagcugggccccgagcugaaccccuaccuggcccaccugagcagaauguacaacggcuacgccggcggcguggaggugcaggugcugcuggccggcaacgccuucaccgccggcaagcugguguucgccgccauccccccccacuuccccguggacaaccugagccccggccagaucaccauguucccccacgugaucaucgacgugagaacccuggagcccgugcugcugccccugcccgacgugagaaacaacuucuuccacuacaaccagcagagcgaccagagaaugagacugaucgccaugcuguacaccccccugagaagcaacggcagcggcgacgacguguucaccgugagcugcagagugcugaccagacccagccccgacuucgacuucaacuaccuggugccccccaccguggagagcaagaccaagcccuucagcgugcccgugcugacccugaacgagcugaccaacagcagauuccccgugcccaucgacgccauguacaccagccccaacgacagcgugguggugcagccccagaacggcagagccaccaucgacggcgagcugcugggcaccacccagcugauccccagcggcaucugcagcuucagaggcaagaucaccacccaccugagcgacgacagacaccuguggaacauccaggugagcaaccugaacggcacccccuucgaccccaccgacgacgugcccgccccccugggcaugcccgacuucagcggccagaucuucggcgugaucagccagagagacaccggcaccaaccccgccaacagagcccacgacgccgugcuggccaccuacagcgccaaguacacccccaagcugggcagcgugcagaucggcaccugggacaccgaggaccugcuggagagacagcccgugaaguucacccccgugggccugaacgagaucggccaggacaagcacuucgaccagugggugcugcccaacuacagcggcgcccugggccugaacaugcaccuggcccccgccgugagcccccuguuccccggcgagagacugcuguucuucagaagcuacaucccccugaagggcggccacggcaaccccuucaucgacugccuggugccccaggaguggauccagcacuucuaccaggagagcgcccccgcccagagcagcguggcccugcugagauacgugaaccccgacaccggcagaacccuguucgaggccaagcugcacaaggagggcuucaucaccgugagcagcaccgagaacagacccgugaucgugccccccaacggcuacuucagauucgacagcugggugaaccaguucuacagccuggcccccaugggcaccggcaacggcagaagaagaaugcaguga

SEQ ID NO: 23548 - RNA, 1593 nt, Artificial Sequence
  derived and/or modified sequence opt4 from capsid_protein__Norovirus__AAS86807
augaugauggccagcaaggacgccaccagcaacguggacggcgccagcggcgccggccagcuggugcccgaggccaacaccagcgacccccuggccauggaccccguggccggcagcagcaccgccguggccaccgccggccaggugaaccccaucgaccccuggaucaucaacaacuucgugcaggccccccagggcgaguucaccaucagccccaacaacacccccggcgacgugcuguucgaccugagccugggcccccaccugaaccccuuccugcugcaccugagccagauguacaacggcugggugggcaacaugagagugagaaucaugcuggccggcaacgccuucaccgccggcaagaucaucgugagcugcaucccccccggcuucggcagccacaaccugaccaucgcccagagcacccuguucccccacgugaucgccgacgugagaacccuggaccccaucgaggugccccuggaggacgugagaaacgugcuguuccacaacaacgacagaaaccagcagaccaugagacuggugugcaugcuguacaccccccugagaaccggcggcggcaccggcgacagcuucgugguggccggcagagugaugaccugccccagccccgacuucaacuuccuguuccuggugccccccaccguggagcagaagaccagacccuucacccugcccaaccugccccugagcagccugagcaacagcagagccccccugcccaucagcagcaugggcaucagccccgacaacgugcagagcgugcaguuccagaacggcagaugcacccuggacggcagacuggugggcaccacccccgugagccugagccagguggccaagaucagaggcaccagcaacggcaccgugaucaaccugaccgagcuggacggcacccccuuccaccccuucgagggccccgcccccaucggcuuccccgaccugggcggcugcgacuggcacgugaacaugacccaguucggccacagcagccagacccaguucgacguggacaccacccccgagaccuucgugccccaccugggcagcauccaggccaacggcgugggcagcggcaacuacaucggcgugcugagcuggaucagcccccccagccaccccagcggcagccagguggaccuguggaagauccccaacuacggcagcagcaucaccgaggccacccaccuggcccccagcguguucccccccggcuucggcgaggugcugguguucuucaugagcaagauccccggccccggcgccuacaaccugcccugccugcugccccaggaguacaucagccacuucgccagcgagcaggcccccaccgugggcgaggccgcccugcugcacuacguggaccccgacaccggcagaaaccugggcgaguucaaggccuaccccgacggcuuccugaccugcgugcccaacggcgccagcagcggcccccagcagcugcccaucaacggcguguucguguucgugagcugggugagcagauucuaccagcugaagcccgugggcaccgccagcagcgccagaggcagacugggccugagaagauga

SEQ ID NO: 23549 - RNA, 1623 nt, Artificial Sequence
  derived and/or modified sequence opt4 from capsid_protein__Norovirus__AAT00237
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcgccuucagaggcgacgugacccacaucgccggcacccacaacuacaccaugaaccuggccagccagaacuggaacaacuacgaccccaccgaggagauccccgccccccugggcacccccgacuucgugggcagaauccagggcaugcugacccagaccaccagaggcgacggcagcaccagaggccacaaggccaccgugagcaccggcgacgugcacuucacccccaagcugggcagcauccaguucaacaccgacaccaacaacgacuucgagaccggccagaacaccaaguucacccccgugggcguggugcaggacggcaacggcacccaccagaacgagccccagcagugggugcugcccagcuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23550 - RNA, 1623 nt, Artificial Sequence; identical to SEQ ID NO: 23549
  derived and/or modified sequence opt4 from capsid_protein__Norovirus__AAT00240

SEQ ID NO: 23551 - RNA, 1623 nt, Artificial Sequence; identical to SEQ ID NO: 23549
  derived and/or modified sequence opt4 from capsid_protein__Norovirus__AAT00243

SEQ ID NO: 23552 - RNA, 1623 nt, Artificial Sequence; identical to SEQ ID NO: 23549
  derived and/or modified sequence opt4 from capsid_protein__Norovirus__AAT00246

SEQ ID NO: 23553 - RNA, 1623 nt, Artificial Sequence
  derived and/or modified sequence opt4 from capsid_protein__Norovirus__AAT00249
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcgccuucagaggcgacgugacccacaucgccggcacccacaacuacaccaugaaccuggccagccagaacuggaacaacuacgaccccaccgaggagauccccgccccccugggcacccccgacuucgugggcagaauccagggcaugcugacccagaccaccagaggcgacggcagcaccagaggccacaaggccaccgugagcaccggcgacgugcacuucacccccaagcugggcagcauccaguucaacaccgacaccaacaacgacuucgagaccggccagaacaccaaguucacccccgugggcguggugcaggacggcaacggcacccaccagaacgagccccagcagugggugcugcccagcuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagaccggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23554 - RNA, 1623 nt, Artificial Sequence
  derived and/or modified sequence opt4 from capsid_protein__Norovirus__AAT00255
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcacccacaacuacaccaugaaccuggccagccagaacuggaacaacuacgaccccaccgaggagauccccgccccccugggcacccccgacuucgugggcagaauccagggcaugcugacccagaccaccagaggcgacggcagcaccagaggccacaaggccaccgugagcaccggcgacgugcacuucacccccaagcugggcagcauccaguucaacaccgacaccaacaacgacuucgagaccggccagaacaccagauucacccccgugggcguggugcaggacggcaacggcacccaccagaacgagccccagcagugggugcugcccagcuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23555 - RNA, 1623 nt, Artificial Sequence; identical to SEQ ID NO: 23554
  derived and/or modified sequence opt4 from capsid_protein__Norovirus__AAT00258

SEQ ID NO: 23556 - RNA, 1623 nt, Artificial Sequence; identical to SEQ ID NO: 23554
  derived and/or modified sequence opt4 from capsid_protein__Norovirus__AAT00261

SEQ ID NO: 23557 - RNA, 1623 nt, Artificial Sequence; identical to SEQ ID NO: 23554
  derived and/or modified sequence opt4 from capsid_protein__Norovirus__AAT00264

SEQ ID NO: 23558 - RNA, 1623 nt, Artificial Sequence; identical to SEQ ID NO: 23554
  derived and/or modified sequence opt4 from capsid_protein__Norovirus__AAT00267

SEQ ID NO: 23559 - RNA, 1623 nt, Artificial Sequence; identical to SEQ ID NO: 23554
  derived and/or modified sequence opt4 from capsid_protein__Norovirus__AAT00270

SEQ ID NO: 23560 - RNA, 1623 nt, Artificial Sequence; identical to SEQ ID NO: 23554
  derived and/or modified sequence opt4 from capsid_protein__Norovirus__AAT00273

SEQ ID NO: 23561 - RNA, 1623 nt, Artificial Sequence; identical to SEQ ID NO: 23554
  derived and/or modified sequence opt4 from capsid_protein__Norovirus__AAT00276

SEQ ID NO: 23562 - RNA, 1623 nt, Artificial Sequence; identical to SEQ ID NO: 23554
  derived and/or modified sequence opt4 from capsid_protein__Norovirus__AAT00279

SEQ ID NO: 23563 - RNA, 1623 nt, Artificial Sequence; identical to SEQ ID NO: 23554
  derived and/or modified sequence opt4 from capsid_protein__Norovirus__AAT00282

SEQ ID NO: 23564 - RNA, 1623 nt, Artificial Sequence; identical to SEQ ID NO: 23554
  derived and/or modified sequence opt4 from capsid_protein__Norovirus__AAT00285

SEQ ID NO: 23565 - RNA, 1623 nt, Artificial Sequence; identical to SEQ ID NO: 23554
  derived and/or modified sequence opt4 from capsid_protein__Norovirus__AAT00288

SEQ ID NO: 23566 - RNA, 1623 nt, Artificial Sequence; identical to SEQ ID NO: 23554
  derived and/or modified sequence opt4 from capsid_protein__Norovirus__AAT00291

SEQ ID NO: 23567 - RNA, 1623 nt, Artificial Sequence; identical to SEQ ID NO: 23554
  derived and/or modified sequence opt4 from capsid_protein__Norovirus__AAT00294

SEQ ID NO: 23568 - RNA, 1623 nt, Artificial Sequence; identical to SEQ ID NO: 23554
  derived and/or modified sequence opt4 from capsid_protein__Norovirus__AAT00297

SEQ ID NO: 23569 - RNA, 1623 nt, Artificial Sequence; identical to SEQ ID NO: 23554
  derived and/or modified sequence opt4 from capsid_protein__Norovirus__AAT00300

SEQ ID NO: 23570 - RNA, 1623 nt, Artificial Sequence; identical to SEQ ID NO: 23554
  derived and/or modified sequence opt4 from capsid_protein__Norovirus__AAT00303

SEQ ID NO: 23571 - RNA, 1623 nt, Artificial Sequence; identical to SEQ ID NO: 23554
  derived and/or modified sequence opt4 from capsid_protein__Norovirus__AAT00306

SEQ ID NO: 23572 - RNA, 1623 nt, Artificial Sequence; identical to SEQ ID NO: 23554
  derived and/or modified sequence opt4 from capsid_protein__Norovirus__AAT00309

SEQ ID NO: 23573 - RNA, 1623 nt, Artificial Sequence; identical to SEQ ID NO: 23554
  derived and/or modified sequence opt4 from capsid_protein__Norovirus__AAT00312

SEQ ID NO: 23574 - RNA, 1623 nt, Artificial Sequence; identical to SEQ ID NO: 23554
  derived and/or modified sequence opt4 from capsid_protein__Norovirus__AAT00315

SEQ ID NO: 23575 - RNA, 1623 nt, Artificial Sequence; identical to SEQ ID NO: 23554
  derived and/or modified sequence opt4 from capsid_protein__Norovirus__AAT00318

SEQ ID NO: 23576 - RNA, 1623 nt, Artificial Sequence; identical to SEQ ID NO: 23554
  derived and/or modified sequence opt4 from capsid_protein__Norovirus__AAT00321

SEQ ID NO: 23577 - RNA, 1623 nt, Artificial Sequence; identical to SEQ ID NO: 23549
  derived and/or modified sequence opt4 from capsid_protein__Norovirus__AAT00324

SEQ ID NO: 23578 - RNA, 1623 nt, Artificial Sequence
  derived and/or modified sequence opt4 from capsid_protein__Norovirus__AAT00330
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcacccacaacuacaccaugaaccuggccagccagaacuggaacaacuacgaccccaccgaggagauccccgccccccugggcacccccgacuucgugggcagaauccagggcaugcugacccagaccaccagaggcgacggcagcaccagaggccacaaggccaccgugagcaccggcgacgugcacuucacccccaagcugggcagcauccaguucaacaccgacaccaacaacgacuucgagaccggccagaacaccaaguucacccccgugggcguggugcaggacggcaacggcacccaccagaacgagccccagcagugggugcugcccagcuacagcggcagaaccggccacaacgugcaccuggcccccgccguggcccccaccuuccccggcgagcagcugcuguucuucagaagcgccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23579 - RNA, 1623 nt, Artificial Sequence; identical to SEQ ID NO: 23578
  derived and/or modified sequence opt4 from capsid_protein__Norovirus__AAT00333

SEQ ID NO: 23580 - RNA, 1623 nt, Artificial Sequence; identical to SEQ ID NO: 23578
  derived and/or modified sequence opt4 from capsid_protein__Norovirus__AAT00336

SEQ ID NO: 23581 - RNA, 1623 nt, Artificial Sequence
  derived and/or modified sequence opt4 from capsid_protein__Norovirus__AAT00342
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcacccacaacuacaccaugaaccuggccagccagaacuggaacaacuacgaccccaccgaggagauccccgccccccugggcacccccgacuucgugggcagaauccagggcaugcugacccagaccaccagaggcgacggcagcaccagaggccacaaggccaccgugagcaccggcgacgugcacuucacccccaagcugggcagcgugcaguucaacaccgacaccaacaacgacuucgagaccggccagaacaccaaguucacccccgugggcguggugcaggacggcaacggcgcccaccagaacgagccccagcagugggugcugcccagcuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23582 - RNA, 1623 nt, Artificial Sequence; identical to SEQ ID NO: 23554
  derived and/or modified sequence opt4 from capsid_protein__Norovirus__AAT00345

SEQ ID NO: 23583 - RNA, 1623 nt, Artificial Sequence
  derived and/or modified sequence opt4 from capsid_protein__Norovirus__AAT00348
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcacccacaacuacaccaugaaccuggccagccagaacuggaacaacuacgaccccaccgaggagauccccgccccccugggcacccccgacuucgugggcagaauccagggcaugcugacccagaccaccagaggcgacggcagcaccagaggccacaaggccaccgugagcaccggcgacgugcacuucacccccaagcugggcagcauccaguucaacaccgacaccaacaacgacuucgagaccggccagaacaccagauucacccccgugggcguggugcaggacggcaacggcacccaccagaacgagccccagcagugggugcugcccagcuacagcggcagaaccggccacaacgugcaccuggcccccgccguggcccccaccuuccccggcgagcagcugcuguucuucagaagcaccacccccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23584 - RNA, 1623 nt, Artificial Sequence; identical to SEQ ID NO: 23554
  derived and/or modified sequence opt4 from capsid_protein__Norovirus__AAT00351

SEQ ID NO: 23585 - RNA, 1623 nt, Artificial Sequence; identical to SEQ ID NO: 23554
  derived and/or modified sequence opt4 from capsid_protein__Norovirus__AAT00354

SEQ ID NO: 23586 - RNA, 1623 nt, Artificial Sequence; identical to SEQ ID NO: 23554
  derived and/or modified sequence opt4 from capsid_protein__Norovirus__AAT00357

SEQ ID NO: 23587 - RNA, 1623 nt, Artificial Sequence; identical to SEQ ID NO: 23554
  derived and/or modified sequence opt4 from capsid_protein__Norovirus__AAT00360

SEQ ID NO: 23588 - RNA, 1623 nt, Artificial Sequence; identical to SEQ ID NO: 23549
  derived and/or modified sequence opt4 from capsid_protein__Norovirus__AAT00363

SEQ ID NO: 23589 - RNA, 1623 nt, Artificial Sequence; identical to SEQ ID NO: 23554
  derived and/or modified sequence opt4 from capsid_protein__Norovirus__AAT00366

SEQ ID NO: 23590 - RNA, 1623 nt, Artificial Sequence; identical to SEQ ID NO: 23554
  derived and/or modified sequence opt4 from capsid_protein__Norovirus__AAT00369

SEQ ID NO: 23591 - RNA, 1623 nt, Artificial Sequence; identical to SEQ ID NO: 23554
  derived and/or modified sequence opt4 from capsid_protein__Norovirus__AAT00372

SEQ ID NO: 23592 - RNA, 1623 nt, Artificial Sequence; identical to SEQ ID NO: 23554
  derived and/or modified sequence opt4 from capsid_protein__Norovirus__AAT00375

SEQ ID NO: 23593 - RNA, 1647 nt, Artificial Sequence
  derived and/or modified sequence opt4 from capsid_protein__Norovirus__AAT70110
augaagauggccagcaaggacgccacccccagcaacgacggcgccgccggccuggugcccgagaucaacaacgaggccauggcccuggaccccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgccuucaccgccggcaagaucaucuucgccgccaucccccccaacuuccccaucgacaaccugagcgccgcccagaucaccaugugcccccacgugaucguggacgugagacagcuggagcccgugaaccugcccaugcccgacgugagaaacaacuucuuccacuacaaccagggcagcgacagcagacugagacugaucgccaugcuguacaccccccugagagccaacaacagcggcgacgacguguucaccgugagcugcagagugcugaccagacccagccccgacuucagcuucaacuuccuggugccccccaccguggagagcaagaccaagcccuucacccugcccauccugaccaucagcgagaugagcaacagcagauuccccgugcccaucgacagccugcacaccagccccaccgagaacaucguggugcagugccagaacggcagagugacccuggacggcgagcugaugggcaccacccagcugcugcccagccagaucugcgccuucagaggcgugcugaccagaagcaccagcagagccagcgaccaggccgacaccgccacccccagacuguucaacuacuacuggcacauccagcuggacaaccugaacggcacccccuacgaccccgccgaggacauccccggcccccugggcacccccgacuucagaggcaagguguucggcguggccagccagagaaaccccgacagcaccaccagagcccacgaggccaagguggacaccaccgccggcagauucacccccaagcugggcagccuggagaucagcaccgagagcggcgacuucgaccagaaccagcccaccagauucacccccgugggcaucggcguggacaacgaggccgacuuccagcaguggagccugcccgacuacagcggccaguucacccacaacaugaaccuggcccccgccguggcccccaacuuccccggcgagcagcugcuguucuucagaagccagcugcccagcagcggcggcagaagcaacggcauccuggacugccuggugccccaggagugggugcagcacuucuaccaggagagcgcccccagccagacccagguggcccuggugagauacgugaaccccgacaccggcagagugcuguucgaggccaagcugcacaagcugggcuucaugaccaucgccaagaacggcgacagccccaucaccgugccccccaacggcuacuucagauucgagagcugggugaaccccuucuacacccuggcccccaugggcaccggcaacggcagaagaagaauccaguga

SEQ ID NO: 23594 - RNA, 1623 nt, Artificial Sequence
  derived and/or modified sequence opt4 from capsid_protein__Norovirus__AAT73592
auggccagcaaggacgccgcccccagcaccgacggcgccgccggccuggugcccgagagcaacaacgaggugauggcccuggagcccguggccggcgccgcccuggccgcccccgugaccggccagaccaacaucaucgaccccuggaucagaaccaacuucgugcaggcccccaacggcgaguucaccgugagccccagaaacgcccccggcgaggugcugcugaaccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccguggagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagaccagcaacagcagauuccccgugcccaucgaccagauguacaccagccccaacgaggugaucagcgugcagugccagaacggcagaugcacccuggacggcgagcugcagggcaccacccagcugcaggugagcggcaucugcgccuucaagggccaggugaccgcccaccugcaggacaacgagcaccuguacaacgugaccaucaccaaccugaacggcagccccuucgaccccagcgaggacauccccgccccccugggcgugcccgacuucgagggcagaguguucggcgugaucagccagagagacaacuacaacagcggcggccagaaccagcccgccaacagaagccacgacgccguggugcccaccuacaccgcccaguacacccccaagcugggccagauccagaucggcaccuggcagaccgacgacaucaccguggaccagcccgccaaguucacccccgugggccugagcgacaccgaccacuucaaccaguggguggugcccagauacgccggcgcccugaaccugaacaccaaccuggcccccagcguggcccccguguuccccggcgagagacugcuguucuucagaagcuacaucccccugaagggcggcuucggcaaccccgccaucgacugccuggugccccaggaguggauccagcacuucuaccaggaggccacccccagccugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagaauccaguga

SEQ ID NO: 23595 - RNA, 1614 nt, Artificial Sequence
  derived and/or modified sequence opt4 from capsid_protein__Norovirus__AAT78480
auggccagcaaggacgccgcccccagcaacgacggcgccaccggccuggugcccgagaucaacaccgagacccugccccuggagcccguggccggcgccgccaucgccgcccccgugaccggccagaacaacaucaucgaccccuggaucagaaacaacuucgugcaggcccccaacggcgaguucaccgugagccccagaaacagccccggcgagauccugaugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggacaugcugagccccgcccagaucaccaugcugccccaccugaucguggacgugagaacccuggagcccaucaugaucccccugcccgacgugagaaacguguucuaccacuucaacaaccagcccgcccccagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucacccugcccauccugaccaucggcgagcugaccaacagcagauuccccgcccccaucgaccagcuguacaccagccccaacgccgacgugguggugcagccccagaacggcagaugcagccuggacggcgagcugcagggcaccacccagcugcugaccaccgccaucugcagcuacagaggcaugaccagcaaccccaccagagacuacugggacggccaccugcugcaccuggugcaccccaacggcgccaccuacgaccccaccgaggacgugcccgcccccuucggcacccaggacuucagaggcauccuguacggcgugcugacccagaaccccagagccagcggcgacgaggccgccaacagccagggcguguacaucagcagcaccagcgagaaguucacccccaagcugggcaccaucggccugcaccaggugcagggccaccacagccagcaccagcagagcaaguucaccccccugggcguggccgugaacggcaacacccccuucagacagugggagcugcccaacuacagcggcgcccugacccugaacaccaaccuggcccccgccgugggccccaacuuccccggcgagcagauccuguucuucagaagcaacgugcccagcgugcagggcggccagcccaucgagaucgacugccugaucccccaggagugggugagccacuucuaccaggagagcgcccccagccagagcgacguggcccuggugagauacgugaaccccgacaccggcagaaccaucuucgaggccaagcugcacagacagggcuucaucaccaucgccgccaccggcagcaaccccgugguggugccccccaacggcuacuucagauucgacagcugggugaaccaguucuacgcccuggcccccaugggcaccggcaacggcagaagaagaauccaguga

SEQ ID NO: 23596 - RNA, 1635 nt, Artificial Sequence
  derived and/or modified sequence opt4 from capsid_protein__Norovirus__AAT78481
auggccagcaaggacgcccccagcaacauggacggcaccagcggcgccggccagcuggugcccgaggccaacaccgccgaccccaucccccuggagcccguggugggcgccgccaccgccgccgccaccgccggccaggugaacaugaucgaccccuggaucaugaacaacuucgugcagagccccgagggcgaguucaccaucagccccaacaacacccccggcgacauccuguucgaccugcagcugggcccccaccugaaccccuuccugcagcaccugagccagauguacaacggcugggugggcaacaugagagugagaauccugcuggccggcaacgccuucagcgccggcaagaucaucaucugcugcgugccccccggcuucaccgcccagaacaucagcaucgcccaggccaccauguucccccacgugaucgccgacgugagagugcuggagcccaucgagaucccccuggacgacgugagaaacgugcuguuccacaccaacgagaacagacccaccaugagacugcugugcaugcuguacaccccccugagagccggcggcgccagcgccggcaccgaccccuucgugaucgccggcagagugcugaccugccccagccccgacuucaacuuccuguuccuggugccccccagcguggagcagaagaccagacagcugaccgugcccaacaucccccugaacaaccugagcaacagcagcgugcccgccaugaucaacaagauggccaucagcagcgacgccaaccagguggugcaguuccagaacggcagaugcaccaccgacggccagcugcugggcaccacccccaucagcgccagccagguggccagaaucagaggcaagguguucagcaccagcagcggcaagggccugaaccugagcgagcuggacggcagccccuaccacgccuucgagagccccgcccccgugggcuuccccgaccugggccacugcgacuggcacgugagcagcuucaaggccgaccagaacagcagcggcgaccccaucagcagacuggacaucaagcagggcgccagcuucgccccccaccugggcagcaucgaguacaccaccagccagaaccccgacggcggccagcugggcacccugaccuggaucagcagccccagcgacgacacccccggccacggcaccaucaaccuguggaagauccccagcuacggcagcaccgugaccgagagcgugcaccuggccccccccaucuacccccccggcuucggcgagacccuggugaaccugaugagcaacuuccccaucggccacaccaacagcaacauggcccaggugcccugcacccugccccaggaguucguggcccacuucgugaacgagcaggcccccgugagaggcgacgccgcccugcugcacuacguggaccccgacacccacagaaaccugggcgaguucaagcuguaccccgagggcuacaucaccugcgugcccaacaccggcggcggcggcccccagagccugcccaccaacggcguguucaucuucagcagcugggugagcagauacuaccagcuggagcccgugggcaccgccggccccgccagaagacugggcgugagaagaguguga

SEQ ID NO: 23597 - RNA, 1620 nt, Artificial Sequence
  derived and/or modified sequence opt4 from capsid_protein__Norovirus__AAU95776
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugaaggccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaccuucagaggcgacgugacccacaucgccggcagccacgacuacaccaugaaccuggccagccagaacuggaacaacuacgaccccaccgaggagauccccgccccccugggcacccccgacuucgugggcaagauccagggcaugcugacccagaccaccagagaggacggcagcaccagagcccacaaggccaccgugagcaccggcagcgugcacuucacccccaagcugggcagcgugcaguacaccaccgacaccaacaacgacuuccagaccggccagaacaccaaguucacccccgugggcgugauccaggacggcaacaaccaccagaacgagccccagcagugggugcugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcgccggcagaagaagagcccuguga

SEQ ID NO: 23598 - RNA, 1644 nt, Artificial Sequence
  derived and/or modified sequence opt4 from capsid_protein__Norovirus__AAX32874
augaagauggccagcaacgacgccgcccccagcaccgacggcagcgccggccuggugcccgaggugaacaacgagaccauggcccuggagcccguggugggcgccccccuggccgcccccguggccggccagcacaacaucaucgaccccuggaucaagaugaacuucgugcaggcccccaacggcgaguucaccgugagccccagaaacgcccccggcgagauccugcuggaccuggagcugggccccgaccugaaccccuaccugagccaccuggccagaauguacaacggcuacgccggcggcauggaggugcagguggugcuggccggcaacgccuucaccgccggcaagaucaucuucgccgccgugccccccaacuuccccgccgagaaccugagcgccgcccaggugaccaugugcccccacgugaucguggacgugagacagcuggagcccgugaugcugcccaugcccgacaucagaaacaagcuguuccacuacaaccagguggacgaccccaagcugagacugcuggccuaccuguacaccccccugagagccaacaacgccggcgacgacguguucaccgugagcugcagagugcugaccagacccacccccgacuucgaguucauguuccuggugccccccaccguggagagcaagaccaagcccuucagccugcccagccugacccuggacgagcugagcaacagcagauuccccgcccccaucgugcagcuguacaccaacccccacgacaaccugguggugcagccccagaacggcagaugcaccaucgacggccugcugcagggcaccacccagcuggugagcugcaacgugugcagcuucagaggcaccaucggcgacggccagcccgccagccacagcgaggaggagaucaugcccauggccuucaacauccagagagagaucaugcuggagaaccuggacggcagccccuacgaccccgccgacgacauccccgccgugcugggcagccccgacuuccagggcaucguguucggcgugcugagccagagaaacgccgacggccagaccagagcccacgaggccaagguggacaccagagccgccagauucgcccccaagcugggcuucgugguggccaccguggagagcaccgacuuccacgccaaccagcccagcagauucacccccgugggccugggcggcgacggcaaccaggacuucaaccagugggcccugcccgccuacggcggcgcccugaccaacaacaccaaccuggccccccccgugaugcccguguaccccggcgagcagauccuguacuucagaagccagcugcccagcagcggcggcguggugggcggcuggcuggacugccugcugccccaggagugggugcagcacuucuuccaggagagcgccaccagccagagcgacguggcccuggugagauacaucaaccccaccaccggcagagugcuguucgaggccaagcugcacaagcagggcuuccugaccguggccgccagcggcagcuacccccugguggugcccgccgacggcuacuucagauucgagagcugggugaaccaguucuacacccuggcccccaugggcaacggcagcggcagaagaagaaccagauga

SEQ ID NO: 23599 - RNA, 1674 nt, Artificial Sequence
  derived and/or modified sequence opt4 from capsid_protein__Norovirus__AAX32877
augaugauggccagcaacgacgccaccgcccccaccgacggcgccgccggccuggugcccgaggugaccaacgagaccauggcccuggagcccguggccggcgccgcccuggccgcccccguggugggccagcacaacgugaucgaccccuggaucagaggcaacuucgugcaggcccccaacggcgaguucaccgugagccccagaaacagccccggcgaggugcugcugaaccuggagcugggccccgagcugaaccccuaccuggcccaccuggccagaauguacaacggcuacgccggcggcauggaggugcagguggugcuggccggcaacgccuucgccgccggcaagaucaucuucgccgccgugccccccagcuuccccguggacgcccugagcgcccccaccaucaccaugugcccccacgugaucguggacgugagacagcuggagcccgugcugcugcccaugcccgacgugagaaacaacuucuuccacuacaaccagagcagcgaccccaagcugagacugguggccaugcuguacaccccccugagagccaacagccccaccgacgacguguucaccgugagcugcagagugcugaccagacccagccccgacuucgaguucaccuuccugaucccccccaccguggagagcaagagcaagcccuucaccaucccccagcugacccugagcgagcugagcaacagcagauuccccgcccccaucgacaugcuguacaccagccccaacgacaacaucguggugcagccccagaacggcagaugcacccuggacggcgagcugcagggcaccacccagcugcagcccagccugaucugcagcuucagaggcgugacccugaacgagaccagcagaaugcugguggaccaggaggaggaggaggagggcgaggugcagagaccccaggccagagccuucaaccacgaguaccaccugcagcugcagaaccuggacggcaccgacuacgaccccgccggcgaccugcccgccacccugggcgcccccgacuucaucggcaccguguacggcguggugagccagagaaccaccagagacagcgccgccagagcccacgaggccaagaucaccaccagcgaccccagauacgcccccaagcugggcagcguggaguucgugaccgagagcaccgacaucgugcugaacgaccagaccaaguucacccccgugggccuggcccacaacagagccguggacuacaagcagugggagcugccccacuacgccggcgagcugaccgccaacaccaaccuggccccccccguggcccccguguaccccggcgagcagcugcuguucuucagaagcaaccugccccuggccggcggcaccgccgccagcgugcuggacugccugcugccccaggaguggauccagcacuucuaccaggagagcuucgccccccagagcgacaucgcccugcugagauacgugaaccccgacaccggcagagugcuguucgaggccaagcugcacagacagggcuacaucaccguggccggcgccggcaccagccccguggccgugccccccaacggcuacuucagauucgagagcugggugagccaguucuacacccuggcccccaugggcagcggcaccggcagaagaagaaaccaguga

SEQ ID NO: 23600 - RNA, 1674 nt, Artificial Sequence
  derived and/or modified sequence opt4 from capsid_protein__Norovirus__AAX32880
augaugauggccagcaacgacgccaccgcccccaccgacggcgccgccggccuggugcccgaggugaccaacgagaccauggcccuggagcccguggccggcgccgcccuggccgcccccguggugggccagcacaacgugaucgaccccuggaucagaggcaacuucgugcaggcccccaacggcgaguucaccgugagccccagaaacagccccggcgaggugcugcugaaccuggagcugggccccgagcugaaccccuaccuggcccaccuggccagaauguacaacggcuacgccggcggcauggaggugcagguggugcuggccggcaacgccuucgccgccggcaagaucaucuucgccgccgugccccccagcuuccccguggacgcccugagcgcccccaccaucaccaugugcccccacgugaucguggacgugagacagcuggagcccgugcugcugcccaugcccgacgugagaaacaacuucuuccacuacaaccagagcagcgaccccaagcugagacugguggccaugcuguacaccccccugagagccaacagccccaccgacgacguguucaccgugagcugcagagugcugaccagacccagccccgacuucgaguucaccuuccugaucccccccaccguggagagcaagagcaagcccuucaccaucccccagcugacccugagcgagcugagcaacagcagauuccccgcccccaucgacaugcuguacaccagccccaacgacaacaucguggugcagccccagaacggcagaugcacccugggcggcgagcugcagggcaccacccagcugcagcccagccugaucugcagcuucagaggcgugacccugaacgagaccagcagaaugcugguggaccaggaggaggaggaggagggcgaggugcagagaccccaggccagagccuucaaccacgaguaccaccugcagcugcagaaccuggacggcaccgacuacgaccccgccggcgaccugcccgccacccugggcgcccccgacuucaucggcaccguguacggcguggugagccagagaaccaccagagacagcgccgccagagcccacgaggccaagaucaccaccagcgaccccagauacgcccccaagcugggcagcguggaguucgugaccgagagcaccgacaucgugcugaacgaccagaccaaguucacccccgugggccuggcccacaacagagccguggacuacaagcagugggagcugccccacuacgccggcgagcugaccgccaacaccaaccuggccccccccguggcccccguguaccccggcgagcagcugcuguucuucagaagcaaccugccccuggccggcggcaccgccgccagcgugcuggacugccugcugccccaggaguggauccagcacuucuaccaggagagcuucgccccccagagcgacaucgcccugcugagauacgugaaccccgacaccggcagagugcuguucgaggccaagcugcacagacagggcuacaucaccguggccggcgccggcaccagccccguggccgugccccccaacggcuacuucagauucgagagcugggugagccaguucuacacccuggcccccaugggcagcggcaccggcagaagaagaaaccaguga

SEQ ID NO: 23601 - RNA, 1647 nt, Artificial Sequence
  derived and/or modified sequence opt4 from capsid_protein__Norovirus__AAX32886
augaagauggccagcagcgacgccgcccccagcagcgacggcagcgccggccuggugcccgaggugaacagcgagaccauggcccuggagcccguggugggcgccccccuggccgcccccguggccggccagcacaacaucaucgaccccuggaucaagcugaacuucgugcaggcccccaacggcgaguucaccgugagccccagaaacgcccccggcgagauccugcuggaccuggagcugggccccgaccugaaccccuaccuggcccaccugagcagaauguacaacgccuacgccggcggcauggaggugcaggugauccuggccggcaacgccuucaccgccggcaagaucaucuucgccgccgugccccccaacuucccccuggagaaccugagcgccgcccagaucaccaugugcccccacaucaucguggacgugagacagcuggagcccgugaugcugcccaugcccgacgugagaaacagacuguuccacuacaaccaggugagagagcccagacugagacugguggccuaccuguacaccccccugagagccaacaacgccggcgacgacguguucaccgugagcugcagagugcugaccagacccagccaggacuucgaguucauguuccuggugccccccagcguggagagcaagaccaagcccuucagccugcccaaccugacccuggccgagcugagcaacagcagauucccccugcccaucgagcagcuguacaccaacccccuggacaaccugguggugcagccccagaacggcagaugcaccaucgacggcauccugcugggcaccacccagcuggugcccagccugaucugcagcaugagaggcacccuggaggccgaccaggccagcggccacaccgacgacgagagcgugcagagcagagccuucaacagacagagaagccugaugcuggagaaccccgacggcagcgccuucgaccccagcgacgaggugcccgccgugcugggcgugcccgacuucagaggcgugguguucggcgugcugagccagagaaacaacggcgacaccaccagaagccacgaggccaagaucgacaccagaagacccagauacgcccccaagcugggcuucguggaggugcugaccgagagcgacgacuuccagaacggcccccccaccaaguucacccccgugggccugggcggcgacggcaaccccgacuuccagcagugggcccugcccgacuacggcggcgcccugaccaacaacaccaaccuggccccccccguggugcccguguaccccggcgagcagauccuguucuucagaagccagcugcccagcagcggcggcaccguggccggcuggcuggacugccugcugccccaggaguggauccagcacuucuaccaggacagcgccgccgcccagagcgacguggcccuggugagauacaucaaccccgccaccggcagagugcuguucgaggccaagcugcacagacagggcuuccugaccgugagcgccgccggcccccaccccgugguggcccccgccgacggcuacuucagauucgagagcugggugaaccaguucuacacccuggcccccaugggcaacggcagcggcagaagaagaguguacuga

SEQ ID NO: 23602 - RNA, 1623 nt, Artificial Sequence
  derived and/or modified sequence opt4 from capsid_protein__Norovirus__AAZ31376
augaagauggccagcaacgacgccacccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgaggugcugagccccagccaggugaccauguucccccacaucaucguggacgugagacagcuggagcccgugcugaucccccugcccgacgugagaaacaaccuguaccacuacaaccagagcaacgaccccaccaucagacugaucgccaugcuguacaccccccugagagccaacaacgccggcgacgacguguucaccgugagcugcagagugcugaccagacccagccccgacuucgacuucauguuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcgcccagaacuacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcgugcacuucacccccaagcugggcagcgugcaguucagcaccgacaccagcaacgacuucgagaccggccagaacaccagauucacccccgugggcguggugcaggacggcagcaccacccaccagaacgagccccagcagugggugcugcccgacuacagcggcagagacagccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggagagcgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcuggaucaaccaguucuacacccuggcccccaugggcaacggcgccggcagaagaagagcccuguga

SEQ ID NO: 23603 - RNA, 1623 nt, Artificial Sequence
  derived and/or modified sequence opt4 from capsid_protein__Norovirus__AAZ31396
augaagauggccagcaacgacgccacccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgaggugcugagccccagccaggugaccauguucccccacaucaucguggacgugagacagcuggagcccgugcugaucccccugcccgacgugagaaacaaccuguaccacuacaaccagagcaacgaccccaccaucagacugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccagaacuacaccaugaaccuggccagccagaacuggaacaacuacgaccccaccgaggagauccccgccccccugggcacccccgacuucgugggcagaauccagggcgugcugacccagaccaccagaagagacggcagcaccagaggccacaaggccaccgugagcaccggcagcgugcacuucacccccaagcugggcagcgugcaguucagcaccgacaccagcaacgacuucgagaccggccagaacaccagauucacccccgugggcguggugcaggacggcagcaccacccaccagaacgagccccagcagugggugcugcccgacuacagcggcagagacagccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggagagcgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagagcccuguga

SEQ ID NO: 23604 - RNA, 1623 nt, Artificial Sequence
  derived and/or modified sequence opt4 from capsid_protein__Norovirus__AAZ31402
augaagauggccagcaacgacgccagccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugggccccagccaggugaccauguucccccacaucaucguggacgugagacagcuggagcccgugcugaucccccugcuggacgugagaaacaaccuguaccacuacaaccagagcaacgaccccaccaucaagcugaucgccaugcuguacaccccccugagagccaacaacgccggcgaggugguguucaccgugagcugcagagugcugaccagacccagccccgacuucgacuucaucuuccuggugccccccaccguggagagcagaaccaagcccuucaccgugcccauccugaccgccgaggagaugaccaacagcagauuccccaccccccugggcaagcuguucaccggccccagcagcgccuucguggugcagccccagaacggcagaugcgccaccgacggcgugcugcugggcaccacccagcugagccccgugaacaucugcaccuucagaggcgacgugacccacaucgccggcacccacgacuacaccaugaaccuggccagccagaacuggaacaacuacgaccccaccgaggagauccccgccccccugggcacccccgacuucgugggcaagauccagggcgugcugacccagaccaccagaggcgacggcagcaccagaggccacaaggccaccgugagcaccggcagcgugcacuucacccccaagcugggcggcgugcaguucaccaccgacaccaacaacgacuucgagaccggccagaacaccaaguucacccccgugggcgugauccaggacggcaacagcacccaccagaacgagccccagcagugggugcugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacgccggcagagugcuguucgagugcaagccccacaagagcggcuacgugaccguggcccacaccggccagcacgaccuggugaucccccccaacggcuacuucagauucgacagcugggugaaccaguucugcacccuggcccccaugggcaacggcaccggcagaagaagagcccuguga

SEQ ID NO: 23605 - RNA, 1620 nt, Artificial Sequence
  derived and/or modified sequence opt4 from capsid_protein__Norovirus__AAZ31411
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccccagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggaccccgugcugauccccagccccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaccuucagaggcgacgugacccacaucgccggcagccacgacuacaccaugaaccuggccagccagaacuggaucaacuacgaccccaccgaggagauccccgccccccugggcacccccgacuucgugggcaagauccagggcaugcugacccagaccaccagagaggacggcagcaccagagcccacaaggccaccgugagcaccggcagcgugcacuucacccccaagcugggcagcgugcaguacaccaccgacaccaacaacgacuuccagaccggccaggacaccaaguucacccccgugggcgugauccaggacggcaacaaccaccagaacgagccccagcagugggugcugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagcccgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcgccggcagaagaagagcccuguga

SEQ ID NO: 23606 - RNA, 1647 nt, Artificial Sequence
  derived and/or modified sequence opt4 from capsid_protein__Norovirus__AAZ31423
augaagauggccagcagcgacgccacccccagcaacgacggcgccgccggccuggugcccgagaucgacaacgaggccauggcccuggaccccguggccggcgccgccaucgccgccccccugaccggccagcagaacaucaucgaccuguggaucaugaacaacuucgugcaggcccccggcggcgaguucaccgugagccccagaaacagccccggcgaggugcugcugaaccuggagcugggccccgagaucaaccccuaccuggcccaccuggccagaaugcacaacggcuacgccggcggcuucgaggugcagguggugcuggccggcaacgccuucaccgccggcaagaucaucuucgccgccaucccccccaacuuccccaucgacaaccugagcgccgcccagaucaccaugugcccccacgugaucguggacgugagacagcuggagcccgugaaccugcccaugcccgacgugagaaacaacuucuuccacuacaaccagggcagcgacagcagacugagacugaucgccaugcuguacaccccccugagagccaacaacagcggcgacgacguguucaccgugagcugcagagugcugaccagacccagccccgacuucagcuucaacuuccuggugccccccaccguggagagcaagaccaagcccuucacccugcccauccugaccaucagcgagaugagcaacagcagauuccccgugcccaucgacagccugcugaccagccccaccgagaacaucguggugcagugccagaacggcagagugacccuggacggcgagcugaugggcaccacccagcugcugcccagccagaucugcgccuucagaggcgugcugaccagaagcaccagcagagccagcgaccaggccgacaccgccacccccagacuguucaacuacuacuggcacauccagcuggacaaccugaacggcacccccuacgaccccgccgaggacauccccggcccccugggcacccccgacuucagaggcaagguguucggcguggccagccagagaaaccccgacagcaccaccagagcccacgaggccaagguggacaccaccgccggcagauucacccccaagcugggcagccuggagaucagcaccgagagcgacgacuucgaccagaaccagcccaccagauucacccccgugggcaucggcguggacagagaggccgacuuccagcaguggagccugcccgacuacagcggccaguucacccacaacaugaaccuggcccccgccguggcccccaaccugcccggcgagcagcugcuguucuucagaagccagcugcccagcagcggcggcagaagcaccggcauccuggacugccuggugccccaggagugggugcagcacuucuaccaggagagcgcccccgcccagacccagguggcccuggugagauacaucaaccccgacaccggcagagugcuguucgaggccaagcugcacaagcugggcuucaugaccaucgccaagaacggcgacagccccaucaccgugccccccaacggcuacuucagauucgagagcugggugaaccccuucuacacccuggcccccaugggcaccggcagcggcagaagaagaauccaguga

SEQ ID NO: 23607 - RNA, 1623 nt, Artificial Sequence
  derived and/or modified sequence opt4 from capsid_protein__Norovirus__AAZ31428
augaagauggccagcaacgacgccgcccccagcaacgacggcgccgccggccuggugcccgagaucaacaacgaggugaugccccuggagcccguggccggcgccagccuggccacccccguggugggccagcagaacaucaucgaccccuggaucagaaacaacuucgugcaggcccccgccggcgaguucaccgugagccccagaaacagccccggcgagauccugcuggaccuggagcugggccccgagcugaaccccuaccuggcccaccuggccagaauguacaacggccaccccagcggcauggaggagcagaucgugcuggccggcaacgccuucaccgccggcaagaucaucuucgccgccaucccccccggcuuccccuacgagaaccugagccccagccacaugaccaugugcccccacgugaucaucuacgugauccagcuggagcccgugcugaugcugaugcccgagauccagaacaacuucuuccacuacaaccagggcaacgaccccaagcugagacugguggccaugcuguacaccccccugagagccaacaacagcggcgacgacguguucaccgugagcugcagagugcugaccaagcccagccccgacuucgaguucaccuuccuggugccccccaccguggagagcaagaccaaggaguucacccugcccauccugagaaucagcgagaugaccaacagcagauuccccgugcccguggagaugauguacaccgccagaaacgagaaccagguggugcagccccagaacggcagagugacccuggacggcgagcugcugggcaccaccccccugcuggccgugaacaucugcaaguucaagggcgaggugaucgccaagaacggcgacgugagaagcuacagaauggacauggagaucaccaacaccgacggcacccccaucgaccccaccgaggacacccccggccccaucggcagccccgacuuccagggcauccuguucggcguggccagccagagaaacaagaacgagcagaaccccgccaccagagcccacgaggugaacaucaacaccggcggcgaccaguacgcccccaagcuggcccaggugaaguucuucagcgagagccaggacuucgaggugcaccagcccaccguguucacccccgugggcguggccggcgacaccagccaccccuucagacagugggugcugcccagauacggcggccaccugaccaacaacacccaccuggcccccgccguggccccccuguuccccggcgagcagauccuguucuucagaagccagauccccagcagcggcggccacgagcugggcuacauggacugccuggugccccaggagugggugcagcacuucuaccaggaggccgccaccgcccagagcgagguggcccugaucagauucaucaaccccgacaccggcagagugcuguucgaggccaagcugcacaagcagggcuucaucaccguggcccacaccggcgacaaccccaucgugaugccccccaacggcuacuucagauucgaggccugggugaaccaguucuacagccuggcccccgugggcaccggcaacggcagaagaagagugcaguga

SEQ ID NO: 23608 - RNA, 1626 nt, Artificial Sequence
  derived and/or modified sequence opt4 from capsid_protein__Norovirus__ABB02420
augagaaugagcgacggcgccgcccccaaggccaacggcagcgaggccagcggccaggaccuggugcccaccgccguggagcaggccgugcccauccagcccguggccggcgccgcccuggccgcccccgccgccggccagaucaaccagaucgaccccuggaucuuccagaacuucgugcagugcccccugggcgaguucagcaucagccccagaaacacccccggcgagauccuguucgaccuggcccugggccccggccugaaccccuaccuggcccaccugagcgccauguacaccggcugggugggcaacauggaggugcagcuggugcuggccggcaacgccuucaccgccggcaagguggugguggcccuggugccccccuacuuccccaagggcagccugaccaccgcccagaucaccugcuucccccacgugaugugcgacgugagaacccuggagcccauccagcugccccugcuggacgugagaagagugcuguggcacgccacccaggaccaggaggagagcaugagacuggugugcaugcuguacaccccccugagaaccaacagccccggcgacgagagcuucguggugagcggcagacugcugagcaagcccgccgccgacuucaacuucguguaccugaccccccccaucgagagaaccaucuacagaaugguggaccugcccgugcugcagcccagacugugcacccacgccagauggcccgcccccguguacggccugcugguggaccccagccugcccagcaacccccaguggcagaacggcagagugcacguggacggcacccugcugggcaccacccccgugagcggcagcugggugagcugcuucgccgccgaggccgccuacgaguuccagagcggcaccggccagguggccaccuucaccaugaucgagcaggacggcagcgccuacgugcccggcgacagagccgccccccugggcuaccccgacuacagcggccagcuggagaucgaggugcagaccgagaccaccaaggccggcgacaagcugaaggugaccaccuucgagaugauccugggccccaccaccaacguggaccaggcccccuaccagggcagagccuacgccagccugaccgccguggccagccuggaccugguggacggcagagugagagccgugcccagaagcaucuacagcuuccaggacgugcugcccgaguacaacgacggccugcuggugccccuggcccccccccugggccccuuccugcccggcgaggugcugcugagauucagaaccuacaugagacagcuggacaccgccgacgccgccgcccagcccaucgacugcgcccugccccaggaguucaucagcugguucgccagcaacagcuucaccgugcagagcgacgcccugcuggugagauacagaaacacccugaccggccagcugcuguucgaggccaagcuguacagcgagggcuacaucgccgugagcuacagcggcagcggcccccugaccuuccccaccgacggcuucuucgagguggugagcugggugcccagacuguuccagcuggccagcgugggcagccuggccaccggcagaacccugaagcaguga

SEQ ID NO: 23609 - RNA, 1626 nt, Artificial Sequence
  derived and/or modified sequence opt4 from capsid_protein__Norovirus__ABB02423
augagaaugagcgacggcgccgcccccaaggccaacggcagcgaggccagcggccaggaccuggugcccaccgccguggagcaggccgugcccauccagcccguggccggcgccgcccuggccgcccccgccgccggccagaucaaccagaucgaccccuggaucuuccagaacuucgugcagugcccccugggcgaguucagcaucagccccagaaacacccccggcgagauccuguucgaccuggcccugggccccggccugaaccccuaccuggcccaccugagcgccauguacaccggcugggugggcaacauggaggugcagcuggugcuggccggcaacgccuucaccgccggcaagguggugguggcccuggugccccccuacuuccccaagggcagccugaccaccgcccagaucaccugcuucccccacgugaugugcgacgugagaacccuggagcccauccagcugccccugcuggacgugagaagagugcuguggcacgccacccaggaccaggaggagagcaugagacuggugugcaugcuguacaccccccugagaaccaacagccccggcgacgagagcuucguggugagcggcagacugcugagcaagcccgccagcgacuucaacuucguguaccugaccccccccaucgagagaaccaucuacagaaugguggaccugcccgugcugcagcccagacugugcacccacgccagauggcccgcccccguguacggccugcugguggaccccagccugcccagcaacccccaguggcagaacggcagagugcacguggacggcacccugcugggcaccacccccgugagcggcagcugggugagcugcuucgccgccgaggccgccuacgaguuccagagcggcaccggcgagguggccaccuucaccaugaucgagcaggacggcagcgccuacgugcccggcgacagagccgccccccugggcuaccccgacuucagcggccagcuggagaucgaggugcagaccgagaccaccaagaccggcgacaagcugaaggugaccaccuucgagaugauccugggccccaccaccaacguggaccaggcccccuaccagggcagagccuacgccagccugaccgccgccgccagccuggaccugguggacggcagagugagagccgugcccagaagcguguacagcuuccaggacgagcugcccgaguacaacgacggccugcuggugccccuggcccccccccugggccccuuccugcccggcgaggugcugcugagauucagaaccuacaugagacagcuggacaccgccgacgccagcgcccagcccaucgacugcgcccugccccaggaguucaucagcugguucgccagcaacaacuucaccgugcagagcgacgcccugcuggugagauacagaaacacccugaccggccagcugcuguucgaggccaagcuguacagcgagggcuacaucgccgugagcuacagcggcagcggcccccugaccuuccccaccgacggcuucuucgagguggugagcugggugcccagacuguuccagcuggccagcgugggcagccuggugaccggcagaacccugaagcaguga

SEQ ID NO: 23610 - RNA, 1623 nt, Artificial Sequence
  derived and/or modified sequence opt4 from capsid_protein__Norovirus__ABC96746
augaagauggccagcaacgacgccagcagcagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccacgacuacaccaugaaccuggccagccagaacuggaacaacuacgaccccaccgaggagauccccgccccccugggcacccccgacuucgugggcaagauccagggcgugcugacccagaccaccagaggcgacggcagcaccagaggccacaaggccaccgugagcaccggcagcgugcacuucacccccaagcugggcagcgugcaguucaccaccgacaccaacaacgacuucgagaccggccagaacaccaaguucacccccgugggcguggugcaggacggcaacagcacccaccagaacgagccccagcagugggugcugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagagcccuguga

SEQ ID NO: 23611 - RNA, 1620 nt, Artificial Sequence
  derived and/or modified sequence opt4 from capsid_protein__Norovirus__ABD77588
augaagauggccagcaacgacgccagccccagcgacggcagcaccgccaaccuggugcccgaggugaacaacgaggugauggcccuggagcccguggugggcgccgccaucgccgcccccguggccggccagcagaacgugaucgaccccuggaucagaaacagcagcgugcaggcccccggcggcgaguucaccgugagccccagagacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgccccccccaacuuccccaccgagggccugagccccagccaggugaccauguucccccacaucaucgugggcgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaacugcagcagagugcccgccgugccccugagcagcaaccacaagaugcagugcaccaccgacggcgugcugcugggcaccacccagcugagccccgugaacaucugcaccuucagaggcgacgugacccacauccccggcaccagaaccuacagaaugaaccuggccagccagaacuggaacaacuacgaccccaccgaggagauccccgccccccugggcacccccgacuucgugggcaagauccagggcaugcugacccagaccaccaagggcgacggcagcaccagaggccacaaggccaccgugagcaccggcagcguggacuucacccccaagcugggcagcgugcaguucgccaccgacaccgacaacgacuucgagaccggccagaacaccagauucacccccgugggcgugauccaggacggcagcagcacccacagaaacgagccccagcagugggugcugcccgacuacagcggcagaaccgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccagccagagcgacguggcccugcugagauucgugaaccccgacaccggcagagugcuguucgagugcaagcugcacaaggccggcuacgugaccguggcccacaccggccagcacgaccuggugaucccccccaacggcuacuucagauucgacagcugggugaaccaguucuacacccuggcccccaugggcaacggcgccggcagaagaagagcccuguga

SEQ ID NO: 23612 - RNA, 1623 nt, Artificial Sequence
  derived and/or modified sequence opt4 from capsid_protein__Norovirus__ABD77589
augaagauggccagcaacgacgccagccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcaccagaaccuacagaaugaaccuggccagccagaacuggaacaacuacgaccccaccgaggagauccccgccccccugggcacccccgacuucgugggcaagauccagggcaugcugacccagaccaccaagggcgacggcagcaccagaggccacaaggccaccgugagcaccggcagcguggacuucacccccaagcuggacagcgugcaguucgccaccgacaccgacaacgacuucgagaccggccagaacaccagauucacccccgugggcgugauccaggacggcagcagcgcccacagaaacgagccccagcagugggugcugcccgacuacagcggcagaaccgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccagccagagcgacguggcccugcugagauucgugaaccccgacaccggcagagugcuguucgagugcaagcugcacaaggccggcuacgugaccguggcccacaccggccagcacgaccuggugaucccccccaacggcuacuucagauucgacagcugggugaaccaguucuacacccuggcccccaugggcaacggcgccggcagaagaagagcccuguga

SEQ ID NO: 23613 - RNA, 1647 nt, Artificial Sequence
  derived and/or modified sequence opt4 from capsid_protein__Norovirus__ABD77590
augaagauggccagcaacgacgccacccccagcaacgacggcgccgccggccuggugcccgagaucaacaacgaggccauggcccuggaccccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgccuucaccgccggcaagaucaucuucgccgccaucccccccaacuuccccaucgacaaccugagcgccgcccagaucaccaugugcccccacgugaucguggacgugagacagcuggagcccgugaaccugcccaugcccgacgugagaaacaacuucuuccacuacaaccagggcagcgacagcaagcugagacugguggccaugcuguacaccccccugagagccaacaacagcggcgacgacguguucaccgugagcugcagagugcugaccagacccagccccgacuucagcuucaacuuccuggugccccccaccguggagagcaagaccaagcccuucacccugcccauccugaccaucagcgagaugagcaacagcagauuccccgugcccaucgacagccugcacaccagccccaccgagaacaucagcgugcagugccagaacggcagagugacccuggacggcgagcugaugggcaccacccagcugcugcccagccagaucugcgccuucagaggcgugcugaccagaagcaccagcagagccagcgaccaggccgacaccgccacccccagacuguucaacuacuacuggcacauccagcuggacaaccugaacggcacccccuacgaccccgccgaggacauccccggcccccugggcacccccgacuucagaggcaagguguucggcguggccagccagagaaaccccgacagcaccaccagagcccacgaggccaagguggacaccaccgccggcagauucacccccaagcugggcagccuggagaucagcaccgagagcggcgacuucgaccagaaccagcccaccagauucacccccgugggcaucggcguggaccacgaggagaacuuccagcaguggagccugcccgacuacagcggccaguucacccacaacaugaaccuggcccccgccguggcccccaacuuccccggcgagcagcugcuguucuucagaagccagcugcccagcagcggcggcagaagcaacggcauccuggacugccuggugccccaggagugggugcagcacuucuaccaggagagcgcccccgcccagacccagguggcccuggugagauacgugaaccccgacaccggcagagugcuguucgaggccaagcugcacaagcugggcuucaugaccaucgccaagaacggcgacagccccaucaccgugccccccaacggcuacuucagauucgagagcugggugaaccccuucuacacccuggcccccaugggcaccggcaacggcagaagaagaauccaguga

SEQ ID NO: 23614 - RNA, 1626 nt, Artificial Sequence
  derived and/or modified sequence opt4 from capsid_protein__Norovirus__ABG45845
augagaaugagcgacggcgccgcccccaaggccaacggcagcgaggccagcggccaggaccuggugcccaccgccguggagcaggccgugcccauccagcccguggccggcgccagccuggccgcccccgccgccggccagaucaaccagaucgaccccuggaucuuccagaacuucgugcagugcccccugggcgaguucagcaucagccccagaaacacccccggcgagauccuguucgaccuggcccugggccccggccugaaccccuaccuggcccaccugagcgccauguacaccggcugggugggcaacauggaggugcagcuggugcuggccggcaacgccuucaccgccggcaagguggugguggcccuggugccccccuacuuccccaagggcagccugaccaccgcccagaucaccugcuucccccacgugaugugcgacgugagaacccuggagcccauccagcugccccugcuggacgugagaagagugcuguggcacgccacccaggaccaggaggagagcaugagacuggugugcaugcuguacaccccccugagaaccaacagccccggcgacgagagcuucguggugagcggcagacugcugagcaagcccgccgccgacuucaacuucguguaccugaccccccccaucgagagaaccaucuacagaaugguggaccugcccgugcugcagcccagacugugcacccacgccagauggcccgcccccaucuacggccugcugguggaccccagccugcccgccaacccccaguggcagaacggcagagugcacguggacggcacccugcugggcaccacccccgugagcggcagcugggugagcugcuucgccgccgaggccgccuacgaguuccagagcggcaccggcgagguggccaccuucacccugaucgagcaggacggcagcgccuacgugcccggcgacagagccgccccccugggcuaccccgacuucagcggccagcuggagaucgaggugcagaccgagaccaccaagaccggcgacaagcugaccgugaccaccuucgagaugauccugggccccaccaccaacguggaccaggcccccuuccagggcagagccuacgccagccugaccgccgccgccagccuggaccugguggacggcagagugagagccgugcccagaagcaucuacagcuuccaggacgugauccccgaguacaacgacggccugcuggugccccuggccccccccaucggccccuuccugcccggcgaggugcugcugagauucagaaccuacaugagacagaucgacagcagcgacgccgccgccgaggccaucgacugcgcccugccccaggaguucaucagcugguucgccagcaacgccuucaccgugcagagcgaggcccugcugcugagauacagaaacacccugaccggccagcugcuguucgagugcaagcuguacagcgagggcuacaucgcccugagcuacagcggcagcggcccccugaccuuccccaccgacggcuucuucgagguggugagcugggugcccagacuguaccagcuggccagcgugggcagccuggccaccggcagaacccugaagcaguga

SEQ ID NO: 23615 - RNA, 1626 nt, Artificial Sequence
  derived and/or modified sequence opt4 from capsid_protein__Norovirus__ABG45847
augagaaugagcgacggcgccgcccccaaggccaacggcagcgaggccagcggccaggaccuggugcccaccgcccuggagcaggccgugcccauccagcccguggccggcgccagccuggccgcccccgccgccggccagaucaaccagaucgaccccuggaucuuccagaacuucgugcagugcccccugggcgaguucagcaucagccccagaaacacccccggcgagauccuguucgaccuggcccugggccccggccugaaccccuaccuggcccaccugagcgccauguacaccggcugggugggcaacauggaggugcagcuggugcuggccggcaacgccuucaccgccggcaagguggugguggcccuggugccccccuacuuccccaagggcagccugaccaccgcccagaucaccugcuucccccacgugaugugcgacgugagaacccuggagcccauccagcugccccugcuggacgugagaagagugcuguggcacgccacccaggaccaggaggagagcaugagacuggugugcaugcuguacaccccccugagaaccaacagccccggcgacgagagcuucguggugagcggcagacugcugagcaagcccgccgccgacuucaacuucguguaccugaccccccccaucgagagaaccaucuacagaaugguggaccugcccgugcugcagcccagacugugcacccacgccagauggcccgcccccaucuacggccugcugguggaccccagccugcccgccaacccccaguggcagaacggcagagugcacguggacggcacccugcugggcaccacccccgugagcggcagcugggugagcugcuucgccgccgaggccgccuacgaguuccagagcggcaccggcgagguggccgccuucacccugaucgagcaggacggcagcgccuacgugcccggcgacagagccgccccccugggcuaccccgacuucagcggccagcuggagaucgaggugcagaccgagaccaccaagaccggcgacaagcugaccgugaccaccuucgagaugauccugggccccaccaccaacguggaccaggcccccuuccagggcagaguguacgccagccugaccgccgccgccagccuggaccugguggacggcagagugagagccgugcccagaagcaucuacggcuuccaggacgugauccccgaguacaacgacggccugcuggugccccuggccccccccaucggccccuuccugcccggcgaggugcugcugagauucagaaccuacaugagacagaucgacagcagcgacgccgccgccgaggccaucgacugcgcccugccccaggaguucaucagcugguucgccagcaacgccuucaccgugcagagcgaggcccugcugcugagauacagaaacacccugaccggccagcugcuguucgagugcaagcuguacagcgagggcuacaucgcccugagcuacagcggcagcggcccccugaccuuccccaccgacggcuucuucgagguggugagcugggugcccagacuguaccagcuggccagcgugggcagccuggccaccggcagaacccugaagcaguga

SEQ ID NO: 23616 - RNA, 1626 nt, Artificial Sequence
  derived and/or modified sequence opt4 from capsid_protein__Norovirus__ABG45849
augagaaugagcgacggcgccgcccccaaggccaacggcagcgaggccagcggccaggaccuggugcccaccgccguggagcaggccgugcccauccagcccguggccggcgccagccuggccgcccccgccgccggccagaucaaccagaucgaccccuggaucuuccagaacuucgugcagugcccccugggcgaguucagcaucagccccagaaacacccccggcgagauccuguucgaccuggcccugggccccggccugaaccccuaccuggcccaccugagcgccauguacaccggcugggugggcaacauggaggugcagcuggugcuggccggcaacgccuucaccgccggcaagguggugguggcccuggugccccccuacuuccccagaggcagccugaccaccgcccagaucaccugcuucccccacgugaugugcgacgugagaacccuggagcccauccagcugccccugcuggacgugagaagagugcuguggcacgccacccaggaccaggaggagagcaugagacuggugugcaugcuguacaccccccugagaaccaacagccccggcgacgagagcuucguggugagcggcagacugcugagcaagcccgccgccgacuucaacuucguguaccugaccccccccaucgagagaaccaucuacagaaugguggaccugcccgugcugcagcccagacugugcacccacgccagauggcccgcccccaucuacggccugcuggugggccccagccugcccgccaacccccaguggcagaacggcagagugcacguggacggcacccugcugggcaccacccccgugagcggcagcugggugagcugcuucgccgccgaggccgccuacgaguuccagagcggcaccggcgagguggccgccuucacccugaucgagcaggacggcagcgccuacgugcccggcgacagagccgccccccugggcuaccccgacuucagcggccagcuggagaucgaggugcagaccgagaccaccaagaccggcgacaagcugaccgugaccaccuucgagaugauccugggccccaccaccaacguggaccaggcccccuuccagggcagaguguacgccagccugaccgccgccgccagccuggaccugguggacggcagagugagagccgugcccagaagcaucuacggcuuccaggacgugauccccgaguacaacgacggccugcuggugccccuggccccccccaucggccccuuccugcccggcgaggugcugcugagauucagaaccuacaugagacagaucgacagcagcgacgccgccgccgaggccaucgacugcgcccugccccaggaguucaucagcugguucgccagcaacgccuucaccgugcagagcgaggcccugcugcugagauacagaaacacccugaccgagcagcugcuguucgagugcaagcuguacagcgagggcuacaucgcccugagcuacagcggcagcggcccccugaccuuccccaccgacggcuucuucgaggccgugagcugggugcccagacuguaccagcuggccagcgugggcagccuggccaccggcagaacccugaagcaguga

SEQ ID NO: 23617 - RNA, 1626 nt, Artificial Sequence
  derived and/or modified sequence opt4 from capsid_protein__Norovirus__ABG45851
augagaaugagcgacggcgccgcccccaaggccaacggcagcgaggccagcggccaggaccuggugcccaccgccguggagcaggccgugcccauccagcccguggccggcgccagccuggccgcccccgccgccggccagaucaaccagaucgaccccuggaucuuccagaacuucgugcagugcccccugggcgaguucagcaucagccccagaaacacccccggcgagauccuguucgaccuggcccugggccccggccugaaccccuaccuggcccaccugagcgccauguacaccggcugggugggcaacauggaggugcagcuggugcuggccggcaacgccuucaccgccggcaagguggccguggcccuggugccccccuacuuccccaagggcagccugaccaccgcccagaucaccugcuucccccacgugaugugcgacgugagaacccuggagcccauccagcugccccugcuggacgugagaagagugcuguggcacgccacccaggaccaggaggagagcaugagacuggugugcaugcuguacaccccccugagaaccaacagccccggcgacgagagcuucguggugagcggcagacugcugagcaagcccgccgccgacuucaacuucguguaccugaccccccccaucgagagaaccaucuacagaaugguggaccugcccgugcugcagcccagacugugcacccacgccagauggcccgcccccaucuacggccugcugguggaccccagccugcccgccaacccccaguggcagaacggcagagugcacguggacggcacccugcugggcaccacccccgugagcggcagcagagugagcugcuucgccgccgaggccgccuacgaguuccagagcggcaccggcgagguggccaccuucacccugaucgagcaggacggcagcgccuacgugcccggcgacagagccgccccccugggcuaccccgacuucagcggccagcuggagaucgaggugcagaccgagaccaccaagaccggcgacaagcugaccgugaccaccuucgagaugauccugggccccaccaccaacguggaccaggcccccuuccagggcagagccuacgccagccugaccgccgccgccagccuggaccugguggacggcagagugagagccgugcccagaagcaucuacagcuuccaggacgugauccccgaguacaacgacggccugcuggugccccuggccccccccaucggccccuuccugcccggcgaggugcugcugagauucagaaccuacaugagacagaucgacagcagcgacgccgccgccgaggccaucgacugcgcccugccccaggaguucaucagcugguucgccagcaacgccuucaccgugcagagcgaggcccugcugcugagauacagaaacacccugaccggccagcugcuguucgagugcaagcuguacagcgagggcuacaucgcccugagcuacagcggcagcggcccccugaccuuccccaccgacggcuucuucgagguggugagcugggugcccagacuguaccagcuggccagcgugggcagccuggccaccggcagaacccugaagcaguga

SEQ ID NO: 23618 - RNA, 1626 nt, Artificial Sequence
  derived and/or modified sequence opt4 from capsid_protein__Norovirus__ABI95835
augagaaugagcgacggcgccgcccccaaggccaacggcagcgaggccagcggccaggaccuggugcccaccgccguggagcaggccgugcccauccagcccguggccggcgccagccuggccgcccccgccgccggccagaucaaccagaucgaccccuggaucuuccagaacuucgugcagugcccccugggcgaguucagcaucagccccagaaacacccccggcgagauccuguucgaccuggcccugggccccggccugaaccccuaccuggcccaccugagcgccauguacaccggcugggugggcaacauggaggugcagcuggugcuggccggcaacgccuucaccgccggcaagguggugguggcccuggugccccccuacuuccccaagggcagccugaccaccgcccagaucaccugcuucccccacgugaugugcgacgugagaacccuggagcccauccagcugccccugcuggacgugagaagagugcuguggcacgccacccaggaccaggaggagagcaugagacuggugugcaugcuguacaccccccugagaaccaacagccccggcgacgagagcuucguggugagcggcagacugcugagcaagcccgccgccgacuucaacuucguguaccugaccccccccaucgagagaaccaucuacagaaugguggaccugcccgugcugcagcccagacugugcacccacgccagauggcccgcccccaucuacggccugcugguggaccccagccugcccgccaacccccaguggcagaacggcagagugcacguggacggcacccugcugggcaccacccccgugagcggcagcugggugagcugcuucgccgccgaggccgccuacgaguuccagagcggcaccggcgagguggccaccuucacccugaucgagcaggacggcagcgccuacgugcccggcgacagagccgccccccugggcuaccccgacuucagcggccagcuggagaucgaggugcagaccgagaccaccaagaccggcgacaagcugaccgugaccaccuucgagaugauccugggccccaccaccaacguggaccaggcccccuuccagggcagagccuacgccagccugaccgccgccgccagccuggaccugguggacggcagagugagagccgugcccagaagcaucuacagcuuccaggacgugauccccgaguacaacgacggccugcuggugccccuggccccccccaucggccccuuccugcccggcgaggugcugcugagauucagaaccuacaugagacagaucgacagcagcgacgccgccgccgaggccaucgacugcgcccugccccaggaguucaucagcugguucgccagcaacgccuucaccgugcagagcgaggcccugcugcugagauacagaaacacccugaccggccagcugcuguucgagugcaagcuguacagcgagggcuacaucgcccugagcuacagcggcagcggcccccugaucuuccccaccgacggcuucuucgagguggugagcugggugcccagacuguaccagcuggccagcgugggcagccuggccaccggcagaacccugaagcaguga

SEQ ID NO: 23619 - RNA, 1620 nt, Artificial Sequence
  derived and/or modified sequence opt4 from capsid_protein__Norovirus__ABI97981
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaaccuacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaccuucagaggcgacgugacccacaucgccggcagccacgacuacaccaugaaccuggccagccagaacuggaacaacuacgaccccaccgaggagauccccgccccccugggcacccccgacuucgugggcaagauccagggcaugcugacccagaccaccagagaggacggcagcaccagagcccacaaggccaccgugagcaccggcagcgugcacuucacccccaagcugggcagcgugcaguacaccaccgacaccaacaacgacuuccagaccggccagaacaccaaguucacccccgugggcgugauccaggacggcaacaaccaccagaacgagccccagcagugggugcugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcgccggcagaagaagagcccuguga

SEQ ID NO: 23620 - RNA, 1626 nt, Artificial Sequence
  derived and/or modified sequence opt4 from capsid_protein__Norovirus__ABP99038
augagaaugagcgacggcgccgcccccaaggccaacggcagcgaggccagcggccaggaccuggugcccaccgccguggagcaggccgugcccauccagcccguggccggcgccagccuggccgcccccgccgccggccagaucaaccagaucgaccccuggaucuuccagaacuucgugcagugcccccugggcgaguucagcaucagccccagaaacacccccggcgagauccuguucgaccuggcccugggccccggccugaaccccuaccuggcccaccugagcgccauguacaccggcugggugggcaacauggaggugcagcuggugcuggccggcaacgccuucaccgccggcaagguggugguggcccuggugccccccuacuuccccaagggcagccugaccaccgcccagaucaccugcuucccccacgugaugugcgacgugagaacccuggagcccauccagcugccccugcuggacgugagaagagugcuguggcacgccacccaggaccaggaggagagcaugagacuggugugcaugcuguacaccccccugagaaccaacagccccggcgacgagagcuucguggugagcggcagacugcugagcaagcccgccgccgacuucaacuucguguaccugaccccccccaucgagagaaccaucuacagaaugguggaccugcccgcccugcagcccagacugugcacccacgccagauggcccgcccccguguacggccugcugguggaccccagccugcccagcagcccccaguggcagaacggcagagugcacguggacggcacccugcugggcaccacccccgugagcggcagcugggugagcugcuucgccgccgaggccgccuacgaguuccagagcggcaccggcgagguggccaccagcacccugaucgagcaggacggcagcgccuacgugcccggcgagagagccgccccccugggcuaccccgacuucagcggccagcuggagaucgaggugcagaccgagaccaccaaggccggcgacaagcugagagugaccaccuucgagaugauccugggccccaccaccaacguggaccaggcccccuaccagggcagaguguacgccagccugaccgccgccgccagccuggaccugguggacggcagagugagagccgugcccagaagcaucuacggcuuccaggacgugauccccgaguacaacgacggccugcuggugccccuggccccccccaucggccccuuccugcccggcgaggugcugcugagauucagaaccuacaugagacagaucgacagcagcgacgccgccgccgaggccaucgacugcgcccugccccaggaguucaucagcugguucgccagcaacgccuucaccgugcagagcgaggcccugcugcugagauacagaaacacccugaccggccagcugcuguucgagugcaagcuguacagcgagggcuacaucgcccugagcuacagcggcagcggcccccuggccuuccccaccgacggcuucuucgagguggugagcugggugcccagacuguaccagcuggccagcgugggcagccuggccaccggcagaacccugaagcaguga

SEQ ID NO: 23621 - RNA, 1626 nt, Artificial Sequence
  derived and/or modified sequence opt4 from capsid_protein__Norovirus__ABP99041
augagaaugagcgacggcgccgcccccaaggccaacggcagcgaggccagcggccaggaccuggugcccaccgccguggagcaggccgugcccauccagcccguggccggcgccgcccuggccgcccccgccgccggccagaucaaccagaucgaccccuggaucuuccagaacuucgugcagugcccccugggcgaguucagcaucagccccagaaacacccccggcgagauccuguucgaccuggcccugggccccggccugaaccccuaccuggcccaccugagcgccauguacaccggcugggugggcaacauggaggugcagcuggugcuggccggcaacgccuucaccgccggcaagguggugguggcccuggugccccccuacuuccccaagggcagccugaccaccgcccagaucaccugcuucccccacgugaugugcgacgugagaacccuggagcccauccagcugccccugcuggacgugagaagagugcuguggcacgccacccaggaccaggaggagagcaugagacuggugugcaugcuguacaccccccugagaaccaacagccccggcgacgagagcuucguggugagcggcagacugcugagcaagcccgccgccgacuucaacuucguguaccugaccccccccaucgagagaaccaucuacagaaugguggaccugcccgugcugcagcccagacugugcacccacgccagauggcccgcccccguguacggccugcugguggaccccagccugcccagcaacccccaguggcagaacggcagagugcacguggacggcacccugcugggcaccacccccgugagcggcagcugggugagcugcuucgccgccgaggccgccuacgaguuccagagcggcaccggcgagguggccaccuucaccaugaucgagcaggacggcagcgccuacgugcccggcgacagagccgccccccugggcuaccccgacuucagcggccagcuggagaucgaggugcagaccgagaccaccaaggccggcgacaagcugaaggugaccaccuucgacaugauccugggccccaccaccaacguggaccaggcccccuaccagggcagagccuacgccagccugaccgccgccgccagccuggaccugguggacggcagagugagagccgugcccagaagcaucuacagcuuccaggacgagcugcccgaguacaacgacggccugcuggugccccuggcccccccccugggccccuuccugcccggcgaggugcugcugagauucagaaccuacaugagacagcuggacaccgccgacgccagcgcccagcccaucgacugcgcccugccccaggaguucaucagcugguucgccagcaacaacuucaccgugcagagcgacgcccugcuggugagauacagaaacacccugaccggccagcugcuguucgaggccaagcuguacagcgagggcuacaucgccgugagcuacagcggcagcggcccccugaccuuccccaccgacggcuucuucgagguggugagcugggugcccagacuguuccagcuggccagcgugggcagccuggccaccggcagaacccugaagcaguga

SEQ ID NO: 23622 - RNA, 1623 nt, Artificial Sequence
  derived and/or modified sequence opt4 from capsid_protein__Norovirus__ABQ12784
augaagauggccagcaacgacgccacccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcagcuucguggugcagccccagaacggcagaugcaccaccgacggcgugcugcugggcaccacccagcugagccccgugaacaucugcaccuucagaggcgacgugacccacaucgccggcacccagaacuacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcgugcacuucacccccaagcugggcagcgugcaguucagcaccgacaccagcaacgacuucgagaccggccagaacaccagauucacccccgugggcguggugcaggacggcagcaccaccccccagaacgagccccagcagugggugcugcccgacuacagcggcagagacagccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggagagcgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagagcccuguga

SEQ ID NO: 23623 - RNA, 1737 nt, Artificial Sequence
  derived and/or modified sequence opt4 from capsid_protein__Norovirus__ABR15783
augaagauggccagcagcgacgccacccccagcagcgacggcgccggcaaccuggugcccgagagccagcaggaggugcugccccuggcccccguggccggcgccgcccuggccgcccccguggugggccagcagaacaucaucgaccccuggaucaaggagaacuucgugcaggccccccagggcgaguucaccgugagccccaagaacagccccggcgaggugcuggugaaccuggagcugagccccagacugaaccccuaccugcaccaccugagcaagauguacaacgccuacgccggcggcauggagguggagaucauccuggccggcaacgccuucaccgccggcaaggugcugaucgccgccgugccccccaacuuccccaucgagaacgugagcgccagccaggccagccaguucccccacgugaucguggacgugagaacccuggagcccaucagacugccccugcccgacgugagaaccaacuucuuccacuacaccacccaggaggagcccagaaugagaaucguggccuggcuguacaccccccugagaaccaacggcagcggcgacgacagcuucaccgugagcggcagaauccugaccagacccagccccgacuucgaguucagcuuccuggugccccccaccguggagaccaagaccgugagcuucagcgugcccggccugguggugcaggacaugagcaacagcagauggcccgcccagaucagcggccugguggugagaggcaacgaggcccagguggugcacuuccagaacggcagaugcaccaccgagggcaugcugcugggcaccaccacccugaacaucaacagcaucugcggccugagaggccugagcgugagccaggccagcgugagaggcgcccccgcccugaccgaggagaugcccccccuggaggacgagguggccgacggcgccgccgccaccuacacccugaccagagccgccgacaccgcccuguggcugagaguggaggagcccgacggcagacccuacgacaucuucggcgaccagcccgccccccugggcacccccgacuucaccgccgugaucgugggcaccgccaucagacccagaaccaccagcggcgccuaccugcacgacgccuacguggacaccacccccggcgacgccgacuucacccccagcaccggcaacaccaagaucgugcugagaggcggcggcagcggccacgugggccagggccacuacuggcaguucaagcccaucgccguggagggcggcggcagcagaccccaguaccaggaguacaaccugcccgacuacgccggccccaccgccagcaaccacgaccuggccccccccguggcccccagaaugcccggcgagcugcugcugcuguucgagagcgacaugcccgugugggacaacggcgccggcgccgcccccgcccagaagauccacugccugcugcccaacgaguucaucacccaccuguucgaccugcaggcccccgcccuggccgaggccgcccugcugagauacgugcaccccgacagcggcagaacccuguucgagugcaagcuguacagagagggcuacauggugguggccgcccccgugggcagacugaacuucccccuggacggcuacuucagauucgacagcugggugagcgccuucuacgugcugagccccgugggcagcggccagggcagaagaggcagaagcaaggccgccuga

SEQ ID NO: 23624 - RNA, 807 nt, Artificial Sequence
  derived and/or modified sequence opt4 from capsid_protein__Norovirus__ABR24136
auggccggcgccuucuucgccggccuggccagcgacgugcugggcagcggccugggcagccugaucaacgccggcgccggcgccaucaaccagaagguggaguucgagaacaacagaaagcugcagcaggccagcuucgaguucagcagcaaccugcagcaggccagcuuccagcacgacaaggagaugcugcaggcccagaucgaggccaccaagaagcugcagcagggcaugaugaaggugaagcaggccaugcugcuggagggcggcuucagcgagaccgacgccgccagaggcgccaucaacgcccccaugaccaaggcccuggacuggagcggcaccagauacugggcccccgacgccagaaccaccaccuacaacgccggcagauucagcaccccccagcccagcggcgcccugcccggcagaaccaaccccagagccaccgugcccgccagaggcagccccagcacccccagcaacaccagcaccgugaccagcguguacagcgaccagaccgugagcaccagacugggcagcaccgccggcagcggcaccagagugagcagccugcccagcaccgccagaaccagaagcuggguggaggaccagaacagaaaccugagccccuucaugagaggcgcccacaacaucagcuucgugaccccccccgccagcagaagcagcagccagggcaccgugagcaccgugcccaaggaggugcuggacagcuggaccggcgccuucaacaccagaagacagccccuguucgcccacaucagaaagagaggcgagagcagagccuga

SEQ ID NO: 23625 - RNA, 1647 nt, Artificial Sequence
  derived and/or modified sequence opt4 from capsid_protein__Norovirus__ABS12173
augaagauggccagcaacgacgccacccccagcaacgacggcgccgccggccuggugcccgagaucaacaacgaggccauggcccuggaccccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgccuucaccgccggcaagaucaucuucgccgccaucccccccaacuuccccaucgacaaccugagcgccgcccagaucaccaugugcccccacgugaucguggacgugagacagcuggagcccgugaaccugcccaugcccgacgugagaaacaacuucuuccacuacaaccagggcagcgacagcagacugagacugaucgccaugcuguacaccccccugagagccaacaacagcggcgacgacguguucaccgugagcugcagagugcugaccagacccagccccgacuucagcuucaacuuccuggugccccccaccguggagagcaagaccaagcccuucacccugcccauccugaccaucagcgagaugagcaacagcagauuccccgugcccaucgacagccugcacaccagccccaccgagaacaucguggugcagugccagaacggcagagugacccuggacggcgagcugaugggcaccacccagcugcugcccagccagaucugcgccuucagaggcgugcugaccagaagcaccagcagacccagcgaccaggccgacaccgccacccccagacuguucaacuacuacuggcacauccagcuggacaaccugaacggcacccccuacgaccccgccgaggacauccccggcccccugggcacccccgacuucagaggcaagguguucggcguggccagccagagaaaccccgacagcaccaccagagcccacgaggccaagguggacaccaccgccggcagauucacccccaagcugggcagccuggagaucagcaccgagagcggcgacuucgaccagaaccagcccaccagauucacccccgugggcaucggcguggaccacgaggccgacuuccagcaguggagccugcccgacuacagcggccaguucacccacaacaugaaccuggcccccgccguggcccccaacuuccccggcgagcagcugcuguucuucagaagccagcugcccagcagcggcggcagaagcaacggcauccuggacugccuggugccccaggagugggugcagcacuucuaccaggagagcgcccccgcccagacccagguggcccuggugagauacgugaaccccgacaccggcagagugcuguucgaggccaagcugcacaagcugggcuucaugaccaucgccaagaacggcgacagccccaucaccgugccccccaacggcuacuucagauucgagagcugggugaaccccuucuacacccuggcccccaugggcaccggcaacggcagaagaagaauccaguga

SEQ ID NO: 23626 - RNA, 1611 nt, Artificial Sequence
  derived and/or modified sequence opt4 from capsid_protein__Norovirus__ABS12175
augaagauggccagcaacgacgccacccccagcgacgacggcgccgccggccuggugcccgagaucaacagcgaggugauggcccuggagcccguggccggcgccagccuggccgcccccguggugggccagcagaacaucaucgaccccuggaucagaaacaacuucgugcaggcccccgccggcgaguucaccgugagccccagaaacagccccggcgagcugcugcuggaccuggagcugggccccgagcugaaccccuaccuggcccaccuggccagaauguacaacggccacgccggcggcauggaggugcagaucgugcuggccggcaacgccuucaccgccggcaagauccuguucgccgccaucccccccagcuuccccuacgagaaccugagccccgcccagcugaccaugugcccccacgugaucguggacgugagacagcuggagcccgugcugcugcccaugcccgacaucagaaacguguucuaccacuacaaccagaacaacagccccaagcugagacugguggccaugcuguacaccccccugagagccaacaacagcggcgacgacguguucaccgugagcugcagagugcugaccagacccagccccgacuuccaguucaccuuccuggugccccccaccguggagagcaagaccaagaacuucacccugcccgugcugagagugagcgagaugaccaacagcagauuccccguggugcuggaccagauguacaccagcagaaacgagaacaucaucgugcagccccagaacggcagaugcaccaccgacggcgagcugcugggcaccaccauccugcagagcgugagcaucugcaacuucaagggcaccaugcaggccaagcugaacgaggagcccagauaccagcugcagcugaccaaccuggacggcagccccaucgaccccaccgacgacaugcccgccccccugggcacccccgacuuccaggccaugcuguacggcguggccagccagagaagcagcagagacaacgccaccagagcccacgacgcccagaucgacaccgccggcgacaccuucgcccccaagaucggccaggugagauucaagagcagcagcaacgacuucgaccugcacgaccccaccaaguucacccccaucggcgugaacguggacgaccagcaccccuucagacagugguuccugcccaacuacggcggccaccuggcccugaacaaccaccuggcccccgccgugaccccccuguuccccggcgagcagauccuguucuucagaagcuacauccccagcgccggcggccacaccgacggcgccauggacugccugcugccccaggaguggguggagcacuucuaccaggaggccgcccccagccagagcgacaucgcccuggugagauucaucaaccccgacaccggcagagugcuguucgaggccaagcugcacaagcagggcuuccugaccaucgccgccagcggcgaccaccccaucgugaugcccaccaacggcuacuucagauucgaggccugggugaaccccuucuacacccuggcccccgugggcaccggcagcggcagaagaagaauccaguga

SEQ ID NO: 23627 - RNA, 1626 nt, Artificial Sequence
  derived and/or modified sequence opt4 from capsid_protein__Norovirus__ABS29273
augagaaugagcgacggcgccgcccccaaggccaacggcagcgaggccagcggccaggaccuggugcccaccgccguggagcaggccgugcccauccagcccguggccggcgccgcccuggccgcccccgccgccggccagaucaaccagaucgaccccuggaucuuccagaacuucgugcagugcccccugggcgaguucagcaucagccccagaaacacccccggcgagauccuguucgaccuggcccugggccccggccugaaccccuaccuggcccaccugagcgccauguacaccggcugggugggcaacauggaggugcagcuggugcuggccggcaacgccuucaccgccggcaagguggugguggcccuggugccccccuacuuccccaagggcagccugaccaccgcccagaucaccugcuucccccacgugaugugcgacgugagaacccuggagcccauccagcugccccugcuggacgugagaagagugcuguggcacgccacccaggaccaggaggagagcaugagacuggugugcaugcuguacaccccccugagaaccaacagccccggcgacgagagcuucguggugagcggcagacugcugagcaagcccgccgccgacuucaacuucguguaccugaccccccccaucgagagaaccaucuacagaaugguggaccugcccgugauccagcccagacugugcacccacgccagauggcccgcccccaucuacggccugcugguggaccccagccugcccagcaacccccaguggcagaacggcagagugcacguggacggcacccugcugggcaccacccccaucagcggcagcugggugagcugcuucgccgccgaggccgccuacgaguuccagagcggcaucggcgagguggccaccuucacccugaucgagcaggacggcagcgccuacgugcccggcgacagagccgccccccugggcuaccccgacuucagcggccagcuggagaucgaggugcagaccgagaccaccaagaccggcgacaagcugaaggugaccaccuucgagaugauccugggccccaccaccaacgccgaccaggcccccuaccagggcagaguguucgccagcgugaccgccgccgccagccuggaccugguggacggcagagugagagccgugcccagaagcguguacagcuucugcgacaccauccccgaguacaacgacggccugcuggugccccuggccccccccaucggccccuuccugcccggcgaggugcugcugagauucagaaccuacaugagacagcuggacaccgccgacgccgccgccgaggccaucgacugcgcccugccccaggaguucgugagcugguucgccagcaacgccuucaccgugcagagcgaggcccugcugcugagauacagaaacacccugaccggccagcugcuguucgagugcaagcuguacagcgagggcuacaucgcccugagcuacagcggcagcggcccccugaccuuccccaccgacggcuucuucgagguggugagcugggugcccagacuguaccagcuggccagcgugggcagccuggccaccggcagaacccugaagcaguga

SEQ ID NO: 23628 - RNA, 1626 nt, Artificial Sequence
  derived and/or modified sequence opt4 from capsid_protein__Norovirus__ABS29275
augagaaugagcgacggcgccgcccccaaggccaacggcagcgaggccagcggccaggaccuggugcccaccgccguggagcaggccgugcccauccagcccguggccggcgccgcccuggccgcccccgccgccggccagaucaaccagaucgaccccuggaucuuccagaacuucgugcagugcccccugggcgaguucagcaucagccccagaaacacccccggcgagauccuguucgaccuggcccugggccccggccugaaccccuaccuggcccaccugagcgccauguacaccggcugggugggcaacauggaggugcagcuggugcuggccggcaacgccuucaccgccggcaagguggugguggcccuggugccccccuacuuccccaagggcagccugaccaccgcccagaucaccugcuucccccacgugaugugcgacgugagaacccuggagcccauccagcugccccugcuggacgugagaagagugcuguggcacgccacccaggaccaggaggagagcaugagacuggugugcaugcuguacaccccccugagaaccaacagccccggcgacgagagcuucguggugagcggcagacugcugagcaagcccgccgccgacuucaacuucguguaccugaccccccccaucgagagaaccaucuacagaaugguggaccugcccgugauccagcccagacugugcacccacgccagauggcccgcccccguguacggccugcugguggaccccagccugcccagcaacccccaguggcagaacggcagagugcacguggacggcacccugcugggcaccacccccaucagcggcagcugggugagcugcuucgccgccgaggccgccuacgaguuccagagcggcaucggcgagguggccaccuucacccugaucgagcaggacggcagcgccuacauccccggcgacagagccgccccccugggcuaccccgacuucagcggccagcuggagaucgaggugcagaccgagaccaccaagaccggcgacaagcugaaggugaccaccuucgagauggugcugggccccaccaccaacguggaccaggcccccuaccagggcagaguguacgccagcgugaccgccgccgccagccuggaccugguggacggcagagugagagccgugcccagaagcaucuacagcuuccaggacaccauccccgaguacaacgacggccugcuggugccccuggccccccccaucggccccuuccugcccggcgaggugcugcugagauucagaaccuacaugagacagcuggacaccgccgacgccgccgccgaggccaucgacugcgcccugccccaggaguucgugagcugguucgccagcaacgccuucaccgugcagagcgaggcccugcugcugagauacagaaacacccugaccggccagcugcuguucgagugcaagcuguacagcgagggcuacaucgcccugagcuacagcggcagcggcccccugaccuuccccaccgacggcuucuucgagguggugagcugggugcccagacuguaccagcuggccagcgugggcagccuggccaccggcagaacccugaagcaguga

SEQ ID NO: 23629 - RNA, 1626 nt, Artificial Sequence
  derived and/or modified sequence opt4 from capsid_protein__Norovirus__ABU55541
augagaaugagcgacggcgccgcccccaaggccaacggcagcgaggccagcggccaggaccuggugcccgccgccguggagcaggccgugcccauccagcccguggccggcgccgcccuggccgcccccgccgccggccagaucaaccagaucgaccccuggaucuuccagaacuucgugcagugcccccugggcgaguucagcaucagccccagaaacacccccggcgagauccuguucgaccuggcccugggccccggccugaaccccuaccuggcccaccugagcgccauguacaccggcugggugggcaacauggaggugcagcuggugcuggccggcaacgccuucaccgccggcaagguggugguggcccuggugccccccuacuuccccaagggcagccugaccaccgcccagaucaccugcuucccccacgugaugugcgacgugagaacccuggagcccauccagcugccccugcuggacgugagaagagugcuguggcacgccacccaggaccaggaggagagcaugagacuggugugcaugcuguacaccccccugagaaccaacagccccggcgacgagagcuucguggugagcggcagacugcugagcaagcccgccgccgacuucaacuucguguaccugaccccccccaucgagagaaccaucuacagaaugguggaccugcccgugauccagcccagacugugcacccacgccagauggcccgcccccguguacggccugcugguggaccccagccugcccagcaacccccaguggcagaacggcagagugcacguggacggcacccugcugggcaccacccccaucagcggcagcugggugagcugcuucgccgccgaggccgccuacaaguuccagagcggcaccggcgagguggccaccuucacccugaucgagcaggacggcagcgccuacgugcccggcgacagagccgccccccugggcuaccccgacuucagcggccagcuggagaucgaggugcagaccgagaccaccaagaccggcgacaagcugaaggugaccaccuucgagaugauccugggccccaccaccaacgccgaccaggcccccuaccagggcagaguguucgccagcgugaccgccgccgccagccuggaccugguggacggcagagugagagccgugcccagaagcaucuacggcuuccaggacaccauccccgaguacaacgacggccugcuggugccccuggccccccccaucggccccuuccugcccggcgaggugcugcugagauucagaaccuacaugagacagaucgacaccgccgacgccgccgccgaggccaucgacugcgcccugccccaggaguucgugagcugguucgccagcaacgccuucaccgugcagagcgaggcccugcugcugagauacagaaacacccugaccggccagcugcuguucgagugcaagcuguacaacgagggcuacaucgcccugagcuacagcggcagcggcccccugaccuuccccaccgacggcaucuucgagguggugagcugggugcccagacuguaccagcuggccagcgugggcagccuggccaccggcagaaugcugaagcaguga

SEQ ID NO: 23630 - RNA, 1626 nt, Artificial Sequence; identical to SEQ ID NO: 23629
  derived and/or modified sequence opt4 from capsid_protein__Norovirus__ABU55544

SEQ ID NO: 23631 - RNA, 1626 nt, Artificial Sequence
  derived and/or modified sequence opt4 from capsid_protein__Norovirus__ABU55547
augagaaugagcgacggcgccgcccccaaggccaacggcagcgaggccagcggccaggaccuggugcccgccgccguggagcaggccgugcccauccagcccguggccggcgccgcccuggccgcccccgccgccggccagaucaaccagaucgaccccuggaucuuccagaacuucgugcagugcccccugggcgaguucagcaucagccccagaaacacccccggcgagauccuguucgaccuggcccugggccccggccugaaccccuaccuggcccaccugagcgccauguacaccggcugggugggcaacauggaggugcagcuggugcuggccggcaacgccuucaccgccggcaagguggugguggcccuggugccccccuacuuccccaagggcagccugaccaccgcccagaucaccugcuucccccacgugaugugcgacgugagaacccuggagcccauccagcugccccugcuggacgugagaagagugcuguggcacgccacccaggaccaggaggagagcaugagacuggugugcaugcuguacaccccccugagaaccaacagccccggcgacgagagcuucguggugagcggcagacugcugagcaagcccgccgccgacuucaacuucguguaccugaccccccccaucgagagaaccaucuacagaaugguggaccugcccgugauccagcccagacugugcacccacgccagauggcccgcccccguguacggccugcugguggaccccagccugcccagcaacccccaguggcagaacggcagagugcacguggacggcacccugcugggcaccacccccaucagcggcagcugggugagcugcuucgccgccgaggccgccuacaaguuccagagcggcaccggcgagguggccaccuucacccugaucgagcaggacggcagcgccuacgugcccggcgacagagccgccccccugggcuaccccgacuucagcggccagcuggagaucgaggugcagaccgagaccaccaagaccggcgacaagcugaaggugaccaccuucgagaugauccugggccccaccaccaacgccgaccaggcccccuaccagggcagaguguucgccagcgugaccgccgccgccagccuggaccugguggacagcagagugagagccgugcccagaagcaucuacggcuuccaggacaccauccccgaguacaacgacggccugcuggugccccuggccccccccaucggccccuuccugcccggcgaggugcugcugagauucagaaccuacaugagacagaucgacaccgccgacgccgccgccgaggccaucgacugcgcccugccccaggaguucgugagcugguucgccagcaacgccuucaccgugcagagcgaggcccugcugcugagauacagaaacacccugaccggccagcugcuguucgagugcaagcuguacaacgagggcuacaucgcccugagcuacagcggcagcggcccccugaccuuccccaccgacggcaucuucgagguggugagcugggugcccagacuguaccagcuggccagcgugggcagccuggccaccggcagaaugcugaagcaguga

SEQ ID NO: 23632 - RNA, 1626 nt, Artificial Sequence; identical to SEQ ID NO: 23629
  derived and/or modified sequence opt4 from capsid_protein__Norovirus__ABU55550

SEQ ID NO: 23633 - RNA, 1626 nt, Artificial Sequence; identical to SEQ ID NO: 23629
  derived and/or modified sequence opt4 from capsid_protein__Norovirus__ABU55553

SEQ ID NO: 23634 - RNA, 1626 nt, Artificial Sequence
  derived and/or modified sequence opt4 from capsid_protein__Norovirus__ABU55556
augagaaugagcgacggcgccgcccccaaggccaacggcagcgacgccagcggccaggaccuggugcccgccgccguggagcaggccgugcccauccagcccguggccggcgccgcccuggccgcccccgccgccggccagaucaaccagaucgaccccuggaucuuccagaacuucgugcagugcccccugggcgaguucagcaucagccccagaaacacccccggcgagauccuguucgaccuggcccugggccccggccugaaccccuaccuggcccaccugagcgccauguacaccggcugggugggcaacauggaggugcagcuggugcuggccggcaacgccuucaccgccggcaagguggugguggcccuggugccccccuacuuccccaagggcagccugaccaccgcccagaucaccugcuucccccacgugaugugcgacgugagaacccuggagcccauccagcugccccugcuggacgugagaagagugcuguggcacgccacccaggaccaggaggagagcaugagacuggugugcaugcuguacaccccccugagaaccaacagccccggcgacgagagcuucguggugagcggcagacugcugagcaagcccgccgccgacuucaacuucguguaccugaccccccccaucgagagaaccaucuacagaaugguggaccugcccgugauccagcccagacugugcacccacgccagauggcccgcccccguguacggccugcugguggaccccagccugcccagcaacccccaguggcagaacggcagagugcacguggacggcacccugcugggcaccacccccaucagcggcagcugggugagcugcuucgccgccgaggccgccuacaaguuccagagcggcaccggcgagguggccaccuucacccugaucgagcaggacggcagcgccuacgugcccggcgacagagccgccccccugggcuaccccgacuucagcggccagcuggagaucgaggugcagaccgagaccaccaagaccggcgacaagcugaaggugaccaccuucgagaugauccugggccccaccaccaacgccgaccaggcccccuaccagggcagaguguucgccagcgugaccgccgccgccagccuggaccugguggacggcagagugagagccgugcccagaagcaucuacggcuuccaggacaccauccccgaguacaacgacggccugcuggugccccuggccccccccaucggccccuuccugcccggcgaggugcugcugagauucagaaccuacaugagacagaucgacaccgccgacgccgccgccgaggccaucgacugcgcccugccccaggaguucgugagcugguucgccagcaacgccuucaccgugcagagcgaggcccugcugcugagauacagaaacacccugaccggccagcugcuguucgagugcaagcuguacaacgagggcuacaucgcccugagcuacagcggcagcggcccccugaccuuccccaccgacggcaucuucgagguggugagcugggugcccagacuguaccagcuggccagcgugggcagccuggccaccggcagaaugcugaagcaguga

SEQ ID NO: 23635 - RNA, 1626 nt, Artificial Sequence
  derived and/or modified sequence opt4 from capsid_protein__Norovirus__ABU55559
augagaaugagcgacggcgccgcccccaaggccaacggcagcgaggccagcggccaggaccuggugcccgccgccguggagcaggccgugcccauccagcccguggccggcgccgcccuggccgcccccgccgccggccagaucaaccagaucgaccccuggaucuuccagaacuucgugcagugcccccugggcgaguucagcaucagccccagaaacacccccggcgagauccuguucgaccuggcccugggccccggccugaaccccuaccuggcccaccugagcgccauguacaccggcugggugggcaacauggaggugcagcuggugcuggccggcaacgccuucaccgccggcaagguggugguggcccuggugccccccuacuuccccaagggcagccugaccaccgcccagaucaccugcuucccccacgugaugugcgacgugagaacccuggagcccauccagcugccccugcuggacgugagaagagugcuguggcacgccacccaggaccaggaggagagcaugagacuggugugcaugcuguacaccccccugagaaccaacagccccggcgacgagagcuucguggugagcggcagacugcugagcaagcccgccgccgacuucaacuucguguaccugaccccccccaucgagagaaccaucuacagaaugguggaccugcccgugauccagcccagacugugcacccacgccagauggcccgcccccguguacggccugcugguggaccccagccugcccagcaacccccaguggcagaacggcagagugcacguggacggcacccugcugggcaccacccccaucagcggcagcugggugagcugcuucgccgccgaggccgccuacgaguuccagagcggcaccggcgagguggccaccuucacccugaucgagcaggacggcagcgccuacgugcccggcgacagagccgccccccugggcuaccccgacuucagcggccagcuggagaucgaggugcagaccgagaccaccaagaccggcgacaagcugaaggugaccaccuucgagaugauccugggccccaccaccaacgccgaccaggcccccuaccagggcagaguguucgccagcgugaccgccgccgccagccuggaccugguggacggcagagugagagccgugcccagaagcaucuacggcuuccaggacaccauccccgaguacaacgacggccugcuggugccccuggccccccccaucggccccuuccugcccggcgaggugcugcugagauucagaaccuacaugagacagaucgacaccgccgacgccgccgccgaggccaucgacugcgcccugccccaggaguucgugagcugguucgccagcaacgccuucaccgugcagagcgaggcccugcugcugagauacagaaacacccugaccggccagcugcuguucgagugcaagcuguacaacgagggcuacaucgcccugagcuacagcggcagcggcccccugaccuuccccaccgacggcaucuucgagguggugagcugggugcccagacuguaccagcuggccagcgugggcagccuggccaccggcagaaugcugaagcaguga

SEQ ID NO: 23636 - RNA, 1626 nt, Artificial Sequence; identical to SEQ ID NO: 23629
  derived and/or modified sequence opt4 from capsid_protein__Norovirus__ABU55562

SEQ ID NO: 23637 - RNA, 1626 nt, Artificial Sequence; identical to SEQ ID NO: 23629
  derived and/or modified sequence opt4 from capsid_protein__Norovirus__ABU55565

SEQ ID NO: 23638 - RNA, 1626 nt, Artificial Sequence
  derived and/or modified sequence opt4 from capsid_protein__Norovirus__ABU55568
augagaaugagcgacggcgccgcccccaaggccaacggcagcgaggccagcggccaggacuucgugcccgccgccguggagcaggccgugcccauccagcccguggccggcgccgcccuggccgcccccgccgccggccagaucaaccagaucgaccccuggaucuuccagaacuucgugcagugcccccugggcgaguucagcaucagccccagaaacacccccggcgagauccuguucgaccuggcccugggccccggccugaaccccuaccuggcccaccugagcgccauguacaccggcugggugggcaacauggaggugcagcuggugcuggccggcaacgccuucaccgccggcaagguggugguggcccuggugccccccuacuuccccaagggcagccugaccaccgcccagaucaccugcuucccccacgugaugugcgacgugagaacccuggagcccauccagcugccccugcuggacgugagaagagugcuguggcacgccacccaggaccaggaggagagcaugagacuggugugcaugcuguacaccccccugagaaccaacagccccggcgacgagagcuucguggugagcggcagacugcugagcaagcccgccgccgacuucaacuucguguaccugaccccccccaucgagagaaccguguacagaaugguggaccugcccgugcugcagcccagacugugcacccacgccagauggcccgcccccguguacggccugcugaucgaccccagccugcccagcaacccccaguggcagaacggcagagugcacgugaacggcacccugcugggcaccacccccgugagcggcagcugggugagcugcuucgccgccgaggccgccuacgaguuccagagcggcaucggcgagguggccaccuucaccaugaucgagcaggacggcagcgccuacgugcccggcgacagagccgccccccugggcuaccccgacuucagcggccagcuggagaucgaggugcagaccgagaccaccaagagcggcgacaagcugaaggugaccaccuucgagaugauccugggccccaccaccaacgccgaccagacccccuaccagggcaagguguacgccagcaucgccgccgccgccagccuggaccugguggacggcagagugagagccgugcccagaagcguguacgccuuccaggacgugcugcccgaguacaacgacggccugcuggugccccuggcccccccccugggccccuuccugcccggcgaggugcugcugagauucagaaccuacgugagacagcuggacaccgccgacgccgccgcccagcccaucgacugcgcccugccccaggaguucaucagcugguucgccagcaacaacuucaccgugcagagcgacgcccugcugaucagauacagaaacacccugaccggccagcugcuguucgaggccaagcuguacagcgagggcuacaucgccgugagcuacagcggcagcggcccccugaccuuccccaccgacggcuucuucgagguggugagcugggugcccagacuguuccagcuggccagcgugggcagccuggccaccggcagaacccugaagcaguga

SEQ ID NO: 23639 - RNA, 1626 nt, Artificial Sequence
  derived and/or modified sequence opt4 from capsid_protein__Norovirus__ABU55571
augagaaugagcgacggcgccgcccccaaggccaacggcagcgaggccagcggccaggaccuggugcccaccgccguggagcaggccgugcccauccagcccguggccggcgccgcccuggccgcccccgccgccggccagaucaaccagaucgaccccuggaucuuccagaacuucgugcagugcccccugggcgaguucagcaucagccccagaaacacccccggcgagauccuguucgaccuggcccugggccccggccugaaccccuaccuggcccaccugagcgccauguacaccggcugggugggcaacauggaggugcagcuggugcuggccggcaacgccuucaccgccggcaagguggugguggcccuggugccccccuacuuccccaagggcagccugaccaccgcccagaucaccugcuucccccacgugaugugcgacgugagaacccuggagcccauccagcugccccugcuggacgugagaagagugcuguggcacgccacccaggaccaggaggagagcaugagacuggugugcaugcuguacaccccccugagaaccaacagccccggcgacgagagcuucguggugagcggcagacugcugagcaagcccgccgccgacuucaacuucguguaccugaccccccccaucgagagaaccguguacagaaugguggaccugcccgugcugcagcccagacugugcacccacgccagauggcccgcccccaucuacggccugcugaucgaccccagccugcccagcaacccccaguggcagaacggcagagugcacgugaacggcacccugcugggcaccacccccgugagcggcagcugggugagcugcuucgccgccgaggccgccuacgaguuccagagcggcaccggcgagguggccaccuucaccaugaucgagcaggacggcagcgccuacgugcccggcgacagagccgccccccugggcuaccccgacuucagcggccagcuggagaucgaggugcagaccgagaccaccaagaccggcgacaagcugaaggugaccaccuucgagauggugcugggccccaccaccaacguggaccaggcccccuaccagggcagaaccuacgccagccugaccgccgccgccagccuggaccugguggacggcagagugagagccgugcccagaagcaucuacagcuuccaggacgugcugcccgaguacaacgacggccugcuggugccccuggcccccccccugggccccuuccugcccggcgaggugcugcugagauucagaaccuacaugagacagcuggacaccgccgacgccgccgcccagcccaucgacugcgcccugccccaggaguucaucagcugguucgccagcaacaacuucaccgugcagagcgacgcccugcugaucagauacagaaacacccugaccggccagcugcuguucgaggccaagcuguacagcgagggcuacaucgccgugagcuacagcggcagcggcccccugaccuuccccaccgacggcuucuucgagguggugagcugggugcccagacuguuccagcuggccagcgugggcagccuggccaccggcagaacccugaagcaguga

SEQ ID NO: 23640 - RNA, 1626 nt, Artificial Sequence
  derived and/or modified sequence opt4 from capsid_protein__Norovirus__ABU55577
augagaaugagcgacggcgccgcccccaaggccaacggcagcgaggccaucggccaggaccuggugcccaccgccguggagcaggccgugcccauccagcccguggccggcgccgcccuggccgcccccgccgccggccagaucaaccagaucgaccccuggaucuuccagaacuucgugcagugcccccugggcgaguucagcaucagccccagaaacacccccggcgagauccuguucgaccuggcccugggccccggccugaaccccuaccuggcccaccugagcgccauguacaccggcugggugggcaacauggaggugcagcuggugcuggccggcaacgccuucaccgccggcaagguggugguggcccuggugccccccuacuuccccaagggcagccugaccaccgcccagaucaccugcuucccccacgugaugugcgacgugagagcccuggagcccauccagcugccccugcuggacgugagaagagugcuguggcacgccacccaggaccaggaggagagcaugagacuggugugcaugcuguacaccccccugagaaccaacagccccggcgacgagagcuucguggugagcggcagacugcugagcaagcccgccgccgacuucaacuucguguaccugaccccccccaucgagagaaccguguacagaaugguggaccugcccgugcugcagcccagacugugcacccacgccagauggcccgcccccguguacggccugcugguggaccccagccugcccagcaacccccaguggcagaacggcagagugcacgugaacggcacccugcugggcaccacccccgugagcggcagcugggugagcugcuucgccgccgaggccgccuacgaguuccagagcggcaccggcgagguggccaccuucaccaugaucgagcaggacggcagcgccuacgugcccggcgacagagccgccccccugggcuaccccgacuucagcggccagcuggagaucgaggugcagaccgagaccaccaagagcggcgacaagcugaaggugaccaccuucgagaugauccugggccccaccaccaacgccgaccagacccccuaccagggcagaguguacgccagcaucgccgccgccgccccccuggaccugguggacggcagagugagagccgugcccagaagcguguacuucuuccaggacgugcugcccgaguacaacgacggccugcuggugccccuggcccccccccugggccccuuccugcccggcgaggugcugcugagauucagaaccuacgugagacagcuggacaccgccgacgccgccgcccagcccaucgacugcgcccugccccaggaguucaucagcugguucgccagcaacagcuucaccgugcagagcgaggcccugcugaucagauacagaaacacccugaccggccagcugcuguucgaggccaagcuguacagcgagggcuacaucgccgugagcuacagcggcagcggcccccugaccuuccccaccgacggcuucuucgagguggugagcugggugcccagacuguuccagcuggccagcgugggcagccuggccaccggcagaacccugaagcaguga

SEQ ID NO: 23641 - RNA, 1626 nt, Artificial Sequence
  derived and/or modified sequence opt4 from capsid_protein__Norovirus__ABU55580
augagaaugagcgacggcgccgcccccaaggccaacggcagcgaggccaucggccaggaccuggugcccaccgccguggagcaggccgugcccauccagcccguggccggcgccgcccuggccgcccccgccgccggccagaucaaccagaucgaccccuggaucuuccagaacuucgugcagugcccccugggcgaguucagcaucagccccagaaacacccccggcgagauccuguucgaccuggcccugggccccggccugaaccccuaccuggcccaccugagcgccauguacaccggcugggugggcaacauggaggugcagcuggugcuggccggcaacgccuucaccgccggcaagguggugguggcccuggugccccccuacuuccccaagggcagccugaccaccgcccagaucaccugcuucccccacgugaugugcgacgugagagcccuggagcccauccagcugccccugcuggacgugagaagagugcuguggcacgccacccaggaccaggaggagagcaugagacuggugugcaugcuguacaccccccugagaaccaacagccccggcgacgagagcuucguggugagcggcagacugcugagcaagcccgccgccgacuucaacuucguguaccugaccccccccaucgagagaaccguguacagaaugguggaccugcccgugcugcagcccagacugugcacccacgccagauggcccgcccccguguacggccugcugguggaccccagccugcccagcaacccccaguggcagaacggcagagugcacgugaacggcacccugcugggcaccacccccgugagcggcagcugggugagcugcuucgccgccgaggccgccuacgaguuccagagcggcaccggcgagguggccaccuucaccaugaucgagcaggacggcagcgccuacgugcccggcgacagagccgccccccugggcuaccccgacuucagcggccagcuggagaucgaggugcagaccgagaccaccaagagcggcgacaagcugaaggugaccaccuucgagaugauccugggccccaccaccaacgccgaccaggcccccuaccagggcagaguguacgccagccuggccgccgccgccccccuggaccugguggacggcagagugagagccgugcccagaagcguguacuucuuccaggacgugcugcccgaguacaacgacggccugcuggugccccuggcccccccccugggccccuuccugcccggcgaggugcugcugagauucagaaccuacgugagacagcuggacaccgccgacgccgccgcccagcccaucgacugcgcccugccccaggaguucaucagcugguucgccagcaacagcuucaccgugcagagcgaggcccugcugaucagauacagaaacacccugaccggccagcugcuguucgaggccaagcuguacagcgagggcuacaucgccgugagcuacagcggcagcggcccccugaccuuccccaccgacggcuucuucgagguggugagcugggugcccagacuguuccagcuggccagcgugggcagccuggccaccggcagaacccugaagcaguga

SEQ ID NO: 23642 - RNA, 1626 nt, Artificial Sequence
  derived and/or modified sequence opt4 from capsid_protein__Norovirus__ABU55586
augagaaugagcgacggcgccgcccccaaggccaacggcagcgaggccaucggccaggaccuggugcccaccgccguggagcaggccgugcccauccagcccguggccggcgccgcccuggccgcccccgccgccggccagaucaaccagaucgaccccuggaucuuccagaacuucgugcagugcccccugggcgaguucagcaucagccccagaaacacccccggcgagauccuguucgaccuggcccugggccccggccugaaccccuaccuggcccaccugagcgccauguacaccggcugggugggcaacauggaggugcagcuggugcuggccggcaacgccuucaccgccggcaagguggugguggcccuggugccccccuacuuccccaagggcagccugaccaccgcccagaucaccugcuucccccacgugaugugcgacgugagagcccuggagcccauccagcugccccugcuggacgugagaagagugcuguggcacgccacccaggaccaggaggagagcaugagacuggugugcaugcuguacaccccccugagaaccaacagccccggcgacgagagcuucguggugagcggcagacugcugagcaagcccgccgccgacuucaacuucguguaccugaccccccccaucgagagaaccguguacagaaugguggaccugcccgugcugcagcccagacugugcacccacgccagauggcccgcccccguguacggccugcugguggaccccagccugcccagcaacccccaguggcagaacggcagagugcacgugaacggcacccugcugggcaccacccccgugagcggcagcugggugagcugcuucgccgccgaggccgccuacgaguuccagagcggcaccggcgagguggccaccuucaccaugaucgagcaggacggcagcgccuacgugcccggcgacagagccgccccccugggcuaccccgacuucagcggccagcuggagaucgaggugcagaccgagaccaccaagagcggcgacaagcugaaggugaccaccuucgagaugauccugggccccaccaccaacgccgaccaggcccccuaccagggcaagguguacgccagccuggccgccgccgccccccuggaccugguggacggcagagugagagccgugcccagaagcguguacuucuuccaggacgugcugcccgaguacaacgacggccugcuggugccccuggcccccccccugggccccuuccugcccggcgaggugcugcugagauucagaaccuacgugagacagcuggacaccgccgacgccgccgcccagcccaucgacugcgcccugccccaggaguucaucagcugguucgccagcaacagcuucaccgugcagagcgacgcccugcugaucagauacagaaacacccugaccggccagcugcuguucgaggccaagcuguacagcgagggcuacaucgccgugagcuacagcggcagcggcccccugaccuuccccaccgacggcuucuucgagguggugagcugggugcccagacuguuccagcuggccagcgugggcagccuggccaccggcagaacccugaagcaguga

SEQ ID NO: 23643 - RNA, 1626 nt, Artificial Sequence
  derived and/or modified sequence opt4 from capsid_protein__Norovirus__ABU55589
augagaaugagcgacggcgccgcccccaaggccaacggcagcgaggccagcggccaggaccuggugcccaccgccguggagcaggccgugcccauccagcccguggccggcgccgcccuggccgcccccgccgccggccagaucaaccagaucgaccccuggaucuuccagaacuucgugcagugcccccugggcgaguucagcaucagccccagaaacacccccggcgagauccuguucgaccuggcccugggccccggccugaaccccuaccuggcccaccugagcgccauguacaccggcugggugggcaacauggaggugcagcuggugcuggccggcaacgccuucaccgccggcaagguggugguggcccuggugccccccuacuuccccaagggcagccugaccaccgcccagaucaccugcuucccccacgugaugugcgacgugagaacccuggagcccauccagcugccccugcuggacgugagaagagugcuguggcacgccacccaggaccaggaggagagcaugagacuggugugcaugcuguacaccccccugagaaccaacagccccggcgacgagagcuucguggugagcggcagacugcugagcaagcccgccgccgacuucaacuucguguaccugaccccccccaucgagagaaccguguacagaaugguggaccugcccgugcugcagcccagacugugcacccacgccagauggcccgcccccguguacggccugcugaucgaccccagccugcccagcaacccccaguggcagaacggcagagugcacgugaacggcacccugcugggcaccacccccgugagcggcagcugggugagcugcuucgccgccgaggccgccuacgaguuccagagcggcaccggcgagguggccaccuucaccaugaucgagcaggacggcagcgccuacgugcccggcgacagagccgccccccugggcuaccccgacuucagcggccagcuggagaucgaggugcagaccgagaccaccaagagcggcgacaagcugagagugaccaccuucgagaugauccugggccccaccaccaacguggaccaggcccccuaccagggcagaguguacgccagccuggccgccgccgccagccuggaccugguggacggcagagugagagccgugcccagaagcguguacagcuuccaggacgugcugcccgaguacaacgacggccugcuggugccccuggcccccccccugggccccuuccugcccggcgaggugcugcugagauucagaaccuacaugagacagcuggacaccgccgacgccgccgcccagcccaucgacugcgcccugccccaggaguucaucagcugguucgccagcaacaacuucaccgugcagagcgacgcccugcugaucagauacagaaacacccugaccggccagcugcuguucgaggccaagcuguacagcgagggcuacaucgccgugagcuacagcggcagcggcccccugaccuuccccaccgacggcuucuucgagguggugagcugggugcccagacuguuccagcuggccagcgugggcagccuggccaccggcagaacccugaagcaguga

SEQ ID NO: 23644 - RNA, 1626 nt, Artificial Sequence
  derived and/or modified sequence opt4 from capsid_protein__Norovirus__ABU55598
augagaaugagcgacggcgccgcccccaaggccagcggcagcgaggccagcggccaggaccuggugcccaccgccguggagcaggccgugcccauccagcccguggccggcgccgcccuggccgcccccgccgccggccagaucaaccagaucgaccccuggaucuuccagaacuucgugcagugcccccugggcgaguucagcaucagccccagaaacacccccggcgagauccuguucgaccuggcccugggccccggccugaaccccuaccuggcccaccugagcgccauguacaccggcugggugggcaacauggaggugcagcuggugcuggccggcaacgccuucaccgccggcaagguggugguggcccuggugccccccuacuuccccaagggcagccugaccaccgcccagaucaccugcuucccccacgugaugugcgacgugagaacccuggagcccauccagcugccccugcuggacgugagaagagugcuguggcacgccacccaggaccaggaggagagcaugagacuggugugcaugcuguacaccccccugagaaccaacagccccggcgacgagagcuucguggugagcggcagacugcugagcaagcccgccgccgacuucaacuucguguaccugaccccccccaucgagagaaccaucuacagaaugguggaccugcccgugcugcagcccagacugugcacccacgccagauggcccgcccccguguacggccugcugguggaccccagccugcccagcaacccccaguggcagaacggcagagugcacaucgacggcacccugcugggcaccacccccgugagcggcagcugggugagcugcuucgccgccgaggccgccuacgaguuccagagcggcaccggcgagguggccaccuucacccugaucgagcaggacggcagcgccuacgugcccggcgacagagccgccccccugggcuaccccgacuucagcggccagcuggagaucgaggugcagaccgagaccaccagagccggcgacaagcugaaggugaccaccuucgagaugauccugggccccaccaccaacguggaccaggcccccuaccagggcagaguguacgccagccugaccgccgccgccagccuggaccugguggacggcagagugagagccgugcccagaagcaucuacagcuuccaggacgugcugcccgaguacaacgacggccugcuggugccccuggccccccccaucggccccuuccugcccggcgaggugcugcugagauucagaaccuacaugagacagguggacagcagcgacgccgccgccgaggccaucgacugcgcccugccccaggaguucgugagcugguucgccagcaacggcuucaccgugcagagcgaggcccugcugcugagauacagaaacacccugaccggccagcugcuguucgagugcaagcuguacagcgagggcuacaucgcccugagcuacagcggcagcggcccccugaccuuccccaccgacggcuucuucgagguggugagcugggugcccagacuguuccagcuggccagcgugggcagccuggugaccggcagaacccugaagcaguga

SEQ ID NO: 23645 - RNA, 1626 nt, Artificial Sequence
  derived and/or modified sequence opt4 from capsid_protein__Norovirus__ABU55601
augagaaugagcgacggcgccgcccccaaggccaacggcagcgaggccagcggccaggaccuggugcccaccgccguggagcaggccgugcccauccagcccguggccggcgccgcccuggccgcccccgccgccggccagaucaaccagaucgaccccuggaucuuccagaacuucgugcagugcccccugggcgaguucagcaucagccccagaaacacccccggcgagauccuguucgaccuggcccugggccccggccugaaccccuaccuggcccaccugagcgccauguacaccggcugggugggcaacauggaggugcagcuggugcuggccggcaacgccuucaccgccggcaagguggugguggcccuggugccccccuacuuccccaagggcagccugaccaccgcccagaucaccugcuucccccacgugaugugcgacgugagaacccuggagcccauccagcugccccugcuggacgugagaagagugcuguggcacgccacccaggaccaggaggagagcaugagacuggugugcaugcuguacaccccccugagaaccaacagccccggcgacgagagcuucguggugagcggcagacugcugagcaagcccgccgccgacuucaacuucguguaccugaccccccccaucgagagaaccaucuacagaauggccgaccugcccgugcugcagcccagacugugcacccacgccagauggcccgcccccguguacggccugcugguggaccccagccugcccagcaacccccaguggcagaacggcagagugcacguggacggcacccugcugggcaccacccccaucagcggcagcugggugagcugcuucgccgccgaggccgccuacgaguuccagagcggcaccggcgagguggccacccugacccugaucgagcaggacggcagcgccuacgugcccggcgacagagccgccccccugggcuaccccgacuucagcggccagcuggagaucgaggugcagaccgagaccaccaaggccggcgacaagcugaaggugaccaccuucgacaugauccugggccccaccaccaacguggaccaggcccccuaccagggcagaguguacgccagcgugagcaccgccgccagccugggccugguggacggcagagugagagccgugcccagaagcaucuacggcuuccaggacaccauccccgaguacaacgacggccugcuggugccccuggccccccccaucggccccuuccugcccggcgaggugcugcugagauucagaaccuacaugagacagaucgacaccgccgacgccgccgccgaggccaucgacugcgcccugccccaggaguucaucagcugguucgccagcaacgccuucaccgugcagagcgaggcccugcugcugagauacagaaacacccugaccggccagcugcuguucgagugcaagcuguacagcgagggcuacaucgcccugagcuacagcggcagcggcccccugaccuuccccaccgacggcuucuucgaggccgugagcugggugcccagacuguaccagcuggccagcgugggcagccuggccaccggcagaacccugaagcaguga

SEQ ID NO: 23646 - RNA, 1626 nt, Artificial Sequence
  derived and/or modified sequence opt4 from capsid_protein__Norovirus__ABU55604
augagaaugagcgacggcgccgcccccagagccaacggcagcgaggccagcggccaggaccuggugcccaccgccguggagcaggccgugcccauccagcccguggccggcgccgcccuggccgcccccgccgccggccagaucaaccagaucgaccccuggaucuuccagaacuucgugcagugcccccugggcgaguucagcaucagccccagaaacacccccggcgagauccuguucgaccuggcccugggccccggccugaaccccuaccuggcccaccugagcgccauguacaccggcugggugggcaacauggaggugcagcuggugcuggccggcaacgccuucaccgccggcaagguggugguggcccuggugccccccuacuuccccaagggcagccugaccaccgcccagaucaccugcuucccccacgugaugugcgacgugagaacccuggagcccauccagcugccccugcuggacgugagaagagugcuguggcacgccacccaggaccaggaggagagcaugagacuggugugcaugcuguacaccccccugagaaccaacagccccggcgacgagagcuucguggugagcggcagacugcugagcaagcccgccgccgacuucaacuucguguaccugaccccccccaucgagagaaccaucuacagaaugguggaccugcccgugauccagcccagacugugcacccacgccagauggcccgcccccaucuacggccugcugguggaccccagccugcccagcaacccccaguggcagaacggcagagugcacguggacggcacccugcugggcaccacccccaucagcggcagcugggugagcugcuucgccgccgaggccgccuacgaguuccagagcggcaccggcgagguggccaccuucacccugaucgagcaggacggcagcgccuacgugcccggcgacagagccgccccccugggcuaccccgacuucagcggccagcuggagaucgaggugcagaccgagaccaccaagaccggcgacaagcugaaggugaccaccuucgagaugauccugggccccaccaccaacguggaccaggcccccuaccagggcagaguguacgccagcguggccgccgccgccagccuggaccugguggacggcagagugagagccgugcccagaagcaucuacggcuuccaggacgugauccccgaguacaacgacggccugcuggugccccuggccccccccaucggccccuuccugcccggcgaggugcugcugagauucagaaccuacaugagacagcuggacaccgccgacgccgccgccgaggccaucgacugcgcccugccccaggaguucgugagcugguucgccagcaacgccuucaccgugcagagcgaggcccugcugcugagauacagaaacacccugaccggccagcugcuguucgagugcaagcuguacagcgagggcuacaucgcccugagcuacagcggcagcggcccccugaccuuccccgccgacggcuucuucgagguggugagcugggugcccagacuguaccagcuggccagcgugggcagccuggccaccggcagaaugcugagacaguga

SEQ ID NO: 23647 - RNA, 1626 nt, Artificial Sequence
  derived and/or modified sequence opt4 from capsid_protein__Norovirus__ABU55607
augagaaugagcgacggcgccgcccccaaggccaacggcagcgaggccagcggccaggaccuggugcccaccgccguggagcaggccgugcccauccagcccguggccggcgccgcccuggccgcccccgccgccggccagaucaaccagaucgaccccuggaucuuccagaacuucgugcagugcccccugggcgaguucagcaucagccccagaaacacccccggcgagauccuguucgaccuggcccugggccccggccugaaccccuaccuggcccaccugagcgccauguacaccggcugggugggcaacauggaggugcagcuggugcuggccggcaacgccuucaccgccggcaagguggugguggcccuggugccccccuacuuccccaagggcagccugaccaccgcccagaucaccugcuucccccacgugaugugcgacgugagaacccuggagcccauccagcugccccugcuggacgugagaagagugcuguggcacgccacccaggaccaggaggagagcaugagacuggugugcaugcuguacaccccccugagaaccaacagccccggcgacgagagcuucguggugagcggcagacugcugagcaagcccgcccccgacuucaacuucguguaccugaccccccccaucgagagaaccaucuacagaaugguggaccugcccgugcugcagcccagacugugcacccacgccagauggcccgcccccguguacggccugcugguggaccccagccugcccagcaacccccaguggcagaacggcagagugcagguggacggcacccugcugggcaccacccccgugagcggcagcugggugagcugcuucgccgccgaggccgccuacgaguuccaggccggcaccggcgagguggugaccuucaccaugaucgagcaggacggcagcgccuacgugcccggcgacagagccgccccccugggcuaccccgacuucagcggccagcuggagaucgaggugcagaccgagaccaccaagaccggcgacaagcugagagugaccaccuucgagaugauccugggccccaccaccaacguggaccaggcccccuaccagggcagagccuacgccagccugaccgccgccgccagccuggaccugguggacggcagagugagagccgugcccagaagcaucuacagcuuccaggacgagcugcccgaguacaacgacggccugcuggugccccuggcccccccccugggccccuuccugcccggcgaggugcugcugagauucagaaccuacaugagacagcuggacaccgccgacgccgccgcccagcccaucgacugcgcccugccccaggaguucaucagcugguucgccagcaacaacuucaccgugcagagcgacgcccugcuggugagauacagaaacacccugaccggccagcugcuguucgaggccaagcuguacagcgagggcuacaucgccgugagcuacagcggcagcggcccccugaccuuccccaccgacggcuucuucgagguggugagcugggugcccagacuguuccagcuggccagcgugggcagccuggugaccggcagaacccugaagcaguga

SEQ ID NO: 23648 - RNA, 1626 nt, Artificial Sequence
  derived and/or modified sequence opt4 from capsid_protein__Norovirus__ABU55610
augagaaugagcgacggcgccgcccccaaggccaacggcagcgaggccagcggccaggaccuggugcccaccgccguggagcaggccgugcccauccagcccguggccggcgccgcccuggccgcccccgccgccggccagaucaaccagaucgaccccuggaucuuccagaacuucgugcagugcccccugggcgaguucagcgugagccccagaaacacccccggcgagauccuguucgaccuggcccugggccccggccugaaccccuaccuggcccaccugagcgccauguacaccggcugggugggcaacauggaggugcagcuggugcuggccggcaacgccuucaccgccggcaagguggugguggcccuggugccccccuacuuccccaagggcagccugaccaccgcccagaucaccugcuucccccacgugaugugcgacgugagaacccuggagcccauccagcugccccugcuggacgugagaagagugcuguggcacgccacccaggaccaggaggagagcaugagacuggugugcaugcuguacaccccccugagaaccaacagccccagcgacgagagcuucguggugagcggcagacugcugagcaagcccgccgccgacuucaacuucguguaccugaccccccccaucgagagaaccaucuacagaaugguggaccugcccgugcugcagcccagacugugcacccacgccagauggcccgcccccguguacggccugcugguggaccccagccugcccagcaacccccaguggcagaacggcagagugcacguggacggcacccugcugggcaccacccccaucagcggcagcugggugagcugcuucgccgccgaggccgccuacgaguuccagagcggcaccggcgagguggccaccuucacccugguggagcaggacggcagcgccuacgugcccggcgacagagccgccccccugggcuaccccgacuucagcggccagcuggagaucgaggugcagaccgagaccaccaagcccggcgagaagcugaaggugaccaccuucgagaugauccugggccccaccaccaacguggaccaggcccccuacagaggcaagguguucgccagcaucaccaccgccgccagccugagccugguggacggcagagugagagccgugcccagaagcaucuacagcuuccaggacgugauccccgaguacaacgacggccugcuggugccccuggccccccccaucggccccuuccugcccggcgaggugcugcugagauucagaaccuacaugagacagcuggacagcgccgacgccgccgccgaggccaucgacugcgcccugccccaggaguucgugagcugguucgccagcaacgccuucaccgugcagagcgaggcccugcugcugagauacagaaacacccugaccggccagcugcuguucgagugcaagcuguacagcgagggcuacaucgcccugagcuacagcggcagcggcccccugaccuuccccaccgacggcuucuucgagguggugagcugggugcccagacuguaccagcuggccagcgugggcagccuggccaccggcagaacccugaagcaguga

SEQ ID NO: 23649 - RNA, 1626 nt, Artificial Sequence
  derived and/or modified sequence opt4 from capsid_protein__Norovirus__ABU55613
augagaaugagcgacggcgccgcccccaaggccaacggcagcgaggccagcggccaggaccuggugcccaccgccguggagcaggccgugcccauccagcccguggccggcagcgcccuggccgcccccgccgccggccagaucaaccagaucgaccccuggaucuuccagaacuucgugcagugcccccugggcgaguucagcaucagccccagaaacacccccggcgagauccuguucgaccuggcccugggccccggccugaaccccuaccuggcccaccugagcgccauguacaccggcugggugggcaacauggaggugcagcuggugcuggccggcaacgccuucaccgccggcaagguggugguggcccuggugccccccuacuuccccaagggcagccugaccaccgcccagaucaccugcuucccccacgugaugugcgacgugagaacccuggagcccauccagcugccccugcuggacgugagaagagugcuguggcacgccacccaggaccaggaggagagcaugagacuggugugcaugcuguacaccccccugagaaccaacagccccggcgacgagagcuucguggugagcggcagacugcugagcaagcccgccgccgacuucaacuucguguaccugaccccccccaucgagagaaccaucuacagaaugguggaccugcccgugcugcagcccagacugugcacccacgccagauggcccgcccccaucuacggccugcugguggaccccagccugcccagcaacccccaguggcagaacggcagagugcacguggacggcacccugcugggcaccacccccgugagcggcagcugggugagcugcuucgccgccgaggccgccuacgaguuccagagcggcaccggcgagguggccaccuucacccugaucgagcaggacggcagcgccuacgugcccggcgacagagccgccccccugggcuaccccgacuucagcggccagcuggagaucgaggugcagaccgagaccaccaagaccggcgacaagcugaaggugaccaccuucgagaugauccugggccccaccaccaacguggaccaggcccccuaccagggcagaguguacgccagccugaccgccguggccagccuggaccugguggacggcagagugagagccgugcccagaagcaucuacggcuuccaggacgugauccccgaguacaacgacggccugcuggugccccuggccccccccaucggccccuuccugcccggcgaggugcugcugagauucagaaccuacaugagacagcuggacaccgccgacgccgccgccgaggccaucgacugcgcccugccccaggaguucaucagcugguucgccagcaacgccuucaccgugcagagcgacgcccugcugcugagauacagaaacacccugaccggccagcugcuguucgagugcaagcuguacagcgagggcuacaucgcccugagcuacagcggcagcggcccccugaccuuccccaccgacggcuucuucgagguggugagcugggugcccagacuguuccagcuggccagcgugggcagccugaccaccggcagaacccugaagcaguga

SEQ ID NO: 23650 - RNA, 1626 nt, Artificial Sequence
  derived and/or modified sequence opt4 from capsid_protein__Norovirus__ABU55616
augagaaugagcgacggcgccgcccccaaggccaacggcagcgaggccagcggccaggaccuggugcccaccgccaucgagcaggccgugcccauccagcccguggccggcagcgcccuggccgcccccgccgccggccagaucaaccagaucgaccccuggaucuuccagaacuucgugcagugcccccugggcgaguucagcaucagccccagaaacacccccggcgagauccuguucgaccuggcccugggccccggccugaaccccuaccuggcccaccugagcgccauguacaccggcugggugggcaacauggaggugcagcuggugcuggccggcaacgccuucaccgccggcaagguggugguggcccuggugccccccuacuuccccaagggcagccugaccaccgcccagaucaccugcuucccccacgugaugugcgacgugagaacccuggagcccauccagcugccccugcuggacgugagaagagugcuguggcacgccacccaggaccaggaggagagcaugagacuggugugcaugcuguacaccccccugagaaccaacagccccggcgacgagagcuucguggugagcggcagacugcugagcaagcccgccgccgacuucaacuucguguaccugaccccccccaucgagagaaccaucuacagaaugguggaccugcccgugcugcagcccagacugugcacccacgccagauggcccgcccccaucuacggccugcugguggaccccagccugcccagcaacccccaguggcagaacggcagagugcacguggacggcacccugcugggcaccacccccgugagcggcagcugggugagcugcuucgccgccgaggccgccuacgaguuccagagcggcaccggcgagguggccaccuucacccugaucgagcaggacggcagcgccuacgugcccggcgacagagccgccccccugggcuaccccgacuucagcggccagcuggagaucgaggugcagaccgagaccaccaagaccggcgacaagcugaaggugaccaccuucgagaugauccugggccccaccaccaacguggaccaggcccccuaccagggcaagguguacgccagccuggccguggccgccagccuggaccugguggacggcagagugagagccgugcccagaagcaucuacggcuuccaggacgugauccccgaguacaacgacggccugcuggugccccuggccccccccaucggccccuuccugcccggcgagauccugcugagauucagaaccuacaugagacagcuggacaccgccgacgccgccgccgaggccaucgacugcgcccugccccaggaguucaucagcugguucgccagcaacgccuucaccgugcaggccgacgcccugcugcugagauacagaaacacccugaccggccagcugcuguucgagugcaagcuguacagcgagggcuacaucgcccugagcuacagcggcagcgccccccugaccuuccccaccgacggcuucuucgagguggugagcugggugcccagacuguuccagcuggccagcgugggcagccugaccaccggcagaacccugaagcaguga

SEQ ID NO: 23651 - RNA, 1626 nt, Artificial Sequence
  derived and/or modified sequence opt4 from capsid_protein__Norovirus__ABU55619
augagaaugagcgacggcgccgcccccaaggccaacggcagcgaggccagcggccaggaccuggugcccaccgccguggagcaggccgugcccauccagcccguggccggcagcgcccuggccgcccccgccgccggccagaucaaccagaucgaccccuggaucuuccagaacuucgugcagugcccccugggcgaguucagcaucagccccagaaacacccccggcgagauccuguucgaccuggcccugggccccggccugaaccccuaccuggcccaccugagcgccauguacaccggcugggugggcaacauggaggugcagcuggugcuggccggcaacgccuucaccgccggcaagguggugguggcccuggugccccccuacuuccccaagggcagccugaccaccgcccagaucaccugcuucccccacgugaugugcgacgugagaacccuggagcccauccagcugccccugcuggacgugagaagagugcuguggcacgccacccaggaccaggaggagagcaugagacuggugugcaugcuguacaccccccugagaaccaacagccccggcgacgagagcuucguggugagcggcagacugcugagcaagcccgccgccgacuucaacuucguguaccugaccccccccaucgagagaaccaucuacagaaugguggaccugcccgugcugcagcccagacugugcacccacgccagauggcccgcccccaucuacggccugcugguggaccccagccugcccagcaacccccaguggcagaacggcagagugcacguggacggcacccugcugggcaccacccccgugagcggcagcugggugagcugcuucgccgccgaggccgccuacgaguuccagagcggcaccggccagguggccaccuucacccugaucgagcaggacggcagcgccuacgugcccggcgacagagccgccccccugggcuaccccgacuucagcggccagcuggagaucgaggugcagaccgagaccaccaaggccggcgacaagcugaaggugaccaccuucgagaugauccugggccccaccaccaacguggaccaggcccccuaccagggcagaguguacgccagccuggccguggccgccagccuggaccugguggacggcagagugagagccgugcccagaagcauccacggcuuccaggacgugauccccgaguacaacgacggccugcuggugccccuggccccccccaucggccccuuccugcccggcgaggugcugcugagauucagaaccuacaugagacagcuggacaccgccgacgccgccgccgaggccaucgacugcgcccugccccaggaguucaucagcugguucgccagcaacgccuucaccgugcagagcgacgcccugcugcugagauacagaaacacccugaccggccagcugcuguucgagugcaagcuguacagcgagggcuacaucgcccugagcuacagcggcagcggcccccugaccuuccccaccgacggcuucuucgagguggugagcugggugcccagacuguuccagcuggccagcgugggcagccuggccaccggcagaacccugaagcaguga

SEQ ID NO: 23652 - RNA, 1626 nt, Artificial Sequence
  derived and/or modified sequence opt4 from capsid_protein__Norovirus__ABU55622
augagaaugagcgacggcgccacccccaaggccaacggcagcgaggccagcggccaggaccuggugcccaccgccguggagcaggccgugcccauccagcccguggccggcgccgcccuggccgcccccgccgccggccagaucaaccagaucgaccccuggaucuuccagaacuucgugcagugcccccugggcgaguucagcaucagccccagaaacacccccggcgagauccuguucgaccuggcccugggccccggccugaaccccuaccuggcccaccugagcgccauguacaccggcugggugggcaacauggaggugcagcuggugcuggccggcaacgccuucaccgccggcaagguggugguggcccuggugccccccuacuuccccaagggcagccugaccaccgcccagaucaccugcuucccccacgugaugugcgacgugagaacccuggagcccauccagcugccccugcuggacgugagaagagugcuguggcacgccacccaggaccaggaggagagcaugagacuggugugcaugcuguacaccccccugagaaccaacagccccggcgacgagagcuucguggugagcggcagacugcugagcaagcccgccgccgacuucaacuucguguaccugaccccccccaucgagagaaccaucuacagaaugguggaccugcccgugauccagcccagacugugcacccacgccagauggcccgcccccguguacggccugcugguggaccccagccugcccagcaacccccaguggcagaacggcagagugcacguggacggcacccugcugggcaccacccccaucagcggcagcugggugagcugcuucgccgccgaggccgccuacgaguuccagagcggcaccggcgagguggccaccuucacccugaucgagcaggacggcagcgccuacgugcccggcgacagagccgccccccugggcuaccccgacuucagcggccagcuggagaucgaggugcagaccgagaccaccaagaccggcgacaagcugaaggugaccaccuucgagaugauccugggccccaccaccaacguggaccaggcccccuaccagggcagaguguucgccagcgugaccgccgccgccagccuggaccugguggacggcagagugagagccgugcccagaagcaucuacggcuuccaggacaccauccccgaguacaacgacggccugcuggugccccuggccccccccaucggccccuuccugcccggcgaggugcugcugagauucagaaccuacaugagacagcuggacaccgccgacgccgccgccgaggccaucgacugcgcccugccccaggaguucgugagcugguucgccagcaacgccuucaccgugcagagcgaggcccugcugcugagauacagaaacacccugaccggccagcugcuguucgagugcaagcuguacagcgagggcuacaucgcccugagcuacagcggcagcggcagccugaccuuccccaccgacggcuucuucgagguggugagcugggugcccagacuguaccagcuggccagcgugggcagccuggccaccggcagaacccugaagcaguga

SEQ ID NO: 23653 - RNA, 1623 nt, Artificial Sequence
  derived and/or modified sequence opt4 from capsid_protein__Norovirus__ABU55628
augagaaugagcgacggcgccgugcccaaggccaacggcagcgaggccagcggccaggaccuggugcccaccgccguggagcaggccgugcccauccagcccguggccggcgccagcaucgccgcccccgccgccggccagaucaaccagaucgaccccuggaucuuccagaacuucgugcagugcccccugggcgaguucagcaucagccccagaaacacccccggcgagauccuguucgaccuggcccugggccccggccugaaccccuaccuggcccaccugagcgccauguacaccggcugggugggcaacauggaggugcagcuggugcuggccggcaacgccuucaccgccggcaagguggugguggcccuggugccccccuacuuccccaagggcagccugaccaccgcccagaucaccugcuucccccacgugaugugcgacgugagaacccuggagcccauccagcugccccugcuggacgugagaagagugcuguggcacgccacccaggaccaggaggagagcaugagacuggugugcaugcuguacaccccccugagaaccaacagccccggcgacgagagcuucguggugagcggcagacugcugagcaagcccgccgccgacuucaacuucguguaccugaccccccccaucgagagaaccaucuacagaaugguggaccugcccgugcugcagcccagacugugcacccacgccagauggcccgcccccaucuacggccugcugguggaccccagccugcccagcaacccccaguggcagaacggcagagugcacguggacggcacccugcugggcaccacccccgugagcggcagcugggugagcugcuucgccgccgaggccgccuacgaguuccagagcggcaccggcgagguggccaccuucacccugaucgagcaggacggcagcgccuacgugcccggcgacagagccgccccccugggcuaccccgacuucagcggccagcuggagaucgaggugcagaccgagaccaccaagaccggcgagaagcugaaggugaccaccuucgagaugauccugggccccgccaccaacguggaccaggcccccuuccagggcagaguguacgccagccugaccgccguggccagccuggaccugguggacggcagagugagagccgugcccagaagcaucuacgccuuccaggacgugauccccgaguacaacgacggccugcuggugccccuggccccccccaucggccccuuccugcccggcgagcugcugcugagauucagaaccuacaugagacagaucgacagcagcgacgccgccgccgaggccaucgacugcgcccugccccaggaguucaucagcugguucgccagcaacgccuucaccgugcagagcgaggcccugcugcugagauacagaaacacccugaccggccagcugcuguucgagugcaagcuguacagcgagggcuacaucgcccugagcuacagcggcagcggcccccugaccuuccccgccgacggcuucuucgagguggugagcugggugcccagacuguuccagcuggccagcgugggcagcagcgccaccggcagaacccugaaguga

SEQ ID NO: 23654 - RNA, 1593 nt, Artificial Sequence
  derived and/or modified sequence opt4 from capsid_protein__Norovirus__ABW74121
augaugauggccagcaaggacgccaccagcagcguggacggcgccagcggcgccggccagcuggugcccgaggugaacgccagcgacccccuggccauggaccccguggccggcagcagcaccgccguggccaccgccggccaggugaaccccaucgaccccuggaucaucaacaacuucgugcaggccccccagggcgaguucaccaucagccccaacaacacccccggcgacgugcuguucgaccugagccugggcccccaccugaaccccuuccugcugcaccugagccagauguacaacggcugggugggcaacaugagagugagaaucaugcuggccggcaacgccuucaccgccggcaagaucaucgugagcugcaucccccccggcuucggcagccacaaccugaccaucgcccaggccacccuguucccccacgugaucgccgacgugagaacccuggaccccaucgaggugccccuggaggacgugagaaacgugcuguuccacaacaacgacagaaaccagcagaccaugagacuggugugcaugcuguacaccccccugagaaccggcagcggcaccggcgacagcuucgugguggccggcagagugaugaccugccccagccccgacuucaacuuccuguuccuggugccccccaccguggagcagaagaccagacccuucacccugcccaaccugccccugagcagccugagcaacagcagagccccccugcccaucagcggcaugggcaucagccccgacaacgugcagagcgugcaguuccagaacggcagaugcacccuggacggcagacuggugggcaccacccccgugagccugagccacguggccaagaucagaggcaccagcaacggcaccgugaucaaccugaccgagcuggacggcacccccuuccaccccuucgagggccccgcccccaucggcuuccccgaccugggcggcugcgacuggcacaucaacaugacccaguucggccacagcagccagacccaguacgacguggacaccacccccgacaccuucgugccccaccugggcagcauccaggccaacggcaucaacagcggcaacuacaucggcgugcugagcugggugagcccccccagccaccccagcggcagccagguggaccuguggaagauccccaacuacggcagcagcaucaccgaggccacccaccuggcccccagcguguucccccccggcuucggcgaggugcugguguucuucaugagcaagauccccggccccggcgccuacagccugcccugccugcugccccaggaguacaucagccaccuggccagcgagcaggcccccaccgugggcgaggccgcccugcugcacuacguggaccccgacaccggcagaaaccugggcgaguucaaggccuaccccgacggcuuccugaccugcgugcccaacggcgccagcagcggcccccagcagcugcccaucaacggcguguucguguucgugagcugggugagcagauucuaccagcugaagcccgugggcaccgccagcaccgccagaggcagacugggccugagaagauga

SEQ ID NO: 23655 - RNA, 1593 nt, Artificial Sequence
  derived and/or modified sequence opt4 from capsid_protein__Norovirus__ABW74123
augaugauggccagcaaggacgccaccagcagcguggacggcgccagcggcgccggccagcuggugcccgaggugaacgccagcgacccccuggccauggaccccguggccggcagcagcaccgccguggccaccgccggccaggugaaccccaucgaccccuggaucaucaacaacuucgugcaggccccccagggcgaguucaccaucagccccaacaacacccccggcgacgugcuguucgaccugagccugggcccccaccugaaccccuuccugcugcaccugagccagauguacaacggcugggugggcaacaugagagugagaaucaugcuggccggcaacgccuucaccgccggcaagaucaucgugagcugcaucccccccggcuucggcagccacaaccugaccaucgcccaggccacccuguucccccacgugaucgccgacgugagaacccuggaccccaucgaggugccccuggaggacgugagaaacgugcuguuccacaacaacgacagaaaccagcagaccaugagacuggugugcaugcuguacaccccccugagaaccggcggcggcaccggcgacagcuucgugguggccggcagagugaugaccugccccagccccgacuucaacuuccuguuccuggugccccccaccguggagcagaagaccagacccuucacccugcccaaccugccccugagcagccugagcaacagcagagccccccugcccaucagcggcaugggcaucagccccgacaacgugcagagcgugcaguuccagaacggcagaugcacccuggacggcagacuggugggcaccacccccgugagccugagccacguggccaagaucagaggcaccagcaacggcaccgugaucaaccugaccgagcuggacggcacccccuuccaccccuucgagggccccgcccccaucggcuuccccgaccugggcggcugcgacuggcacaucaacaugacccaguucggccacagcagccagacccaguacgacguggacaccacccccgacaccuucgugccccaccugggcagcauccaggccaacggcaucaacagcggcaacuacaucggcgugcugagcugggugagcccccccagccaccccagcggcagccagguggaccuguggaagauccccaacuacggcagcagcaucaccgaggccacccaccuggcccccagcguguucccccccggcuucggcgaggugcugguguucuucaugagcaagauccccggccccggcgccuacagccugcccugccugcugccccaggaguacaucagccaccuggccagcgagcaggcccccaccgugggcgaggccgcccugcugcacuacguggaccccgacaccggcagaaaccugggcgaguucaaggccuaccccgacggcuuccugaccugcgugcccaacggcgccagcagcggcccccagcagcugcccaucaacggcguguucguguucgugagcugggugagcagauucuaccagcugaagcccgugggcaccgccagcaccgccagaggcagacugggccugagaagauga

SEQ ID NO: 23656 - RNA, 1593 nt, Artificial Sequence; identical to SEQ ID NO: 23655
  derived and/or modified sequence opt4 from capsid_protein__Norovirus__ABW74124

SEQ ID NO: 23657 - RNA, 1593 nt, Artificial Sequence; identical to SEQ ID NO: 23655
  derived and/or modified sequence opt4 from capsid_protein__Norovirus__ABW74125

SEQ ID NO: 23658 - RNA, 1593 nt, Artificial Sequence; identical to SEQ ID NO: 23655
  derived and/or modified sequence opt4 from capsid_protein__Norovirus__ABW74126

SEQ ID NO: 23659 - RNA, 1593 nt, Artificial Sequence; identical to SEQ ID NO: 23655
  derived and/or modified sequence opt4 from capsid_protein__Norovirus__ABW74127

SEQ ID NO: 23660 - RNA, 1593 nt, Artificial Sequence; identical to SEQ ID NO: 23655
  derived and/or modified sequence opt4 from capsid_protein__Norovirus__ABW74128

SEQ ID NO: 23661 - RNA, 1620 nt, Artificial Sequence
  derived and/or modified sequence opt4 from capsid_protein__Norovirus__ABW74532
augaagauggccagcagcgacgccaaccccagcgacggcagcgccgccaaccuggugcccgaggugaacaacgaggugauggcccuggagcccguggugggcgccgccaucgccgcccccguggccggccagcagaacaucaucgaccccuggaucagaaacaacuucgugcaggcccccggcggcgaguucaccgugagccccagaaacgcccccggcgagauccuguggagcgccccccugggccccgaccugaaccccuaccugagccaccugagcagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacgugaucguggacgugagacagcuggagcccgugcugaucccccugcccgacgugagaaacaacuucuaccacuacaaccaggcccacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccaucccccuggagaagcuguacaccggccccagcagcgacuucguggugcagccccagaacggcagaugcaccaccgacggcgugcugcugggcaccacccagcugagcgccgugaacaucugcaacuucaagggcgacgugacccacaucgccggcagcagagacuacagaaugaaccuggugagccagaacuggaacaacuacgaccccaccgaggagauccccgccccccugggcacccccgacuuccagggcaagauccagggccugcugacccagaccaccggcgccgacggcagcaccagagcccacaaggccaccgugagcaccggcgccgccaacuucacccccaagcugggcagcgugcaguucaccaccgacaccgacaacgacuuccagaccggccagaacaccaaguucacccccgugggcgugauccaggacggcagccaccaccagaacgagccccagcagugggugcugcccaacuacagcggcagaaccgugcacaacgugcaccuggcccccgccguggcccccaccuuccccggcgagcagcugcuguucuucagaagcaccaugcccggcugcagcggcuaccccaacaugaaccuggacugccugcugccccaggagugggugaugcacuucuaccaggaggccgcccccgcccagagcgacguggcccugcugagauucgugaaccccgacaccggcagagugcuguucgagugcaagcugcacaaggccggcuacaucaccguggcccacaccggccagcacgaccuggugaucccccccaacggcuacuucagauucgacagcugggugaaccaguucuacacccuggcccccaugggcaacggcgccggcagaagaagagcccuguga

SEQ ID NO: 23662 - RNA, 1620 nt, Artificial Sequence
  derived and/or modified sequence opt4 from capsid_protein__Norovirus__ABW74533
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaccuucagaggcgacgugacccacaucgccggcagccacgacuacaccaugaaccuggccagccagaacuggaacaacuacgaccccaccgaggagauccccgccccccugggcacccccgacuucgugggcaagauccagggcaugcugacccagaccaccagaggcgacggcagcaccagagcccacaaggccaccgugagcaccggcagcgugcacuucacccccaagcugggcagcgugcaguucaccaccgacaccaacaacgacuuccagaccggccagaacaccaaguucacccccgugggcgugauccaggacggcgacaaccaccagaacgagccccagcagugggugcugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcaccggcagaagaagagcccuguga

SEQ ID NO: 23663 - RNA, 1623 nt, Artificial Sequence
  derived and/or modified sequence opt4 from capsid_protein__Norovirus__ABW74534
augaagauggccagcaacgacgccagccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccagacccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcacccacgacuacaccaugaaccuggccagccagaacuggaacaacuacgaccccaccgaggagauccccgccccccugggcacccccgacuucgugggcaagauccagggcgugcugagccagaccaccagaggcgacggcagcaccagaggccacaaggccaccgugagcaccggcagcgugcacuucacccccaagcugggcagcgugcaguucaccaccgacaccaacaacgaccuggagaccggccagaacaccaaguucacccccgugggcguggugcaggacggcaacagcacccaccagaacgagccccagcagugggugcugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagagcccuguga

SEQ ID NO: 23664 - RNA, 1623 nt, Artificial Sequence; identical to SEQ ID NO: 23554
  derived and/or modified sequence opt4 from capsid_protein__Norovirus__ABW74535

SEQ ID NO: 23665 - RNA, 1620 nt, Artificial Sequence
  derived and/or modified sequence opt4 from capsid_protein__Norovirus__ABW74536
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcagaccauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaccuucagaggcgacgugacccacaucgccggcagccacgacuacaccaugaaccuggccagccagaacuggaacaacuacgaccccaccgaggagauccccgccccccugggcacccccgacuucgugggcaagauccagggcaugcugacccagaccaccagagaggacggcagcaccagagcccacaaggccaccgugagcaccggcagcgugcacuucacccccaagcugggcagcgugcaguacaccaccgacaccaacaacgacuuccaggccggccagaacaccaaguucacccccgugggcgugauccaggacggcaacaaccaccagaacgagccccagcagugggugcugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcaccggcagaagaagagcccuguga

SEQ ID NO: 23666 - RNA, 1623 nt, Artificial Sequence
  derived and/or modified sequence opt4 from capsid_protein__Norovirus__ABW74537
augaagauggccagcaacgacgccagccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcaccagaaccuacagaaugaaccuggccagccagaacuggaacaacuacgaccccaccgaggagauccccgccccccugggcacccccgacuucgugggcaagauccagggcaugcugacccagaccaccaagggcgacggcagcaccagaggccacaaggccaccgugagcaccggcagcguggacuucacccccaagcugggcagcgugcaguucgccaccgacaccgacaacgacuucgagaccggccagaacaccagauucacccccgugggcgugauccaggacggcagcagcgcccacagaaacgagccccagcagugggugcugcccgacuacagcggcagaaccgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagaccggcuacgugaccguggcccacaccggccagcacgaccuggugaucccccccaacggcuacuucagauucgacagcugggugaaccaguucuacacccuggcccccaugggcaacggcgccggcagaagaagagcccuguga

SEQ ID NO: 23667 - RNA, 1623 nt, Artificial Sequence
  derived and/or modified sequence opt4 from capsid_protein__Norovirus__ABW74538
augaagauggccagcaacgacgccagccccagcgacggcagcaccgccaaccuggugcccgaggugaacaacgaggugauggcccuggagcccguggugggcgccgccaucgccgcccccguggccggccagcagaacgugaucgaccccuggaucagaagcaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagcugaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcacccacgacuacaccaugaaccuggccagccagaacuggaacaacuacgaccccaccgaggagauccccgccccccugggcacccccgacuucgugggcaagauccagggcgugcugacccagaccaccagaggcgacggcagcaccagaggccacaaggccaccgugagcaccggcagcgugcacuucacccccaagcugggcagcgugcaguucaccaccgacaccaacaacgaccuggagaccggccagaacaccagauucacccccgugggcguggugcaggacggcaacagcacccaccagaacgagccccagcagugggugcugcccaacuacagcggcagagccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagagcccuguga

SEQ ID NO: 23668 - RNA, 1623 nt, Artificial Sequence
  derived and/or modified sequence opt4 from capsid_protein__Norovirus__ABW74539
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcaccagaaacuacaccaugaaccuggccagccagaacuggaacaacuacgaccccaccgaggagauccccgccccccugggcacccccgacuucgugggcagaauccagggcaugcugacccagaccaccagaagagacggcagcaccagaggccacaaggccaccgugagcaccggcgacgcccacuucacccccaagcugggcagcaucauguucagcaccgacaccgacaacgacuucgagaccggccagaacaccaaguucacccccgugggcguggugcaggacggcaacggcacccaccagaacgagccccagcagugggugcugcccagcuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23669 - RNA, 1623 nt, Artificial Sequence; identical to SEQ ID NO: 22537
  derived and/or modified sequence opt4 from capsid_protein__Norovirus__ABW74540

SEQ ID NO: 23670 - RNA, 1623 nt, Artificial Sequence
  derived and/or modified sequence opt4 from capsid_protein__Norovirus__ABW74541
augaagauggccagcaacgacgccacccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcagcuucguggugcagccccagaacggcagaugcaccaccgacggcgugcugcugggcaccacccagcugagccccgugaacaucugcaccuucagaggcgacgugacccacaucgccggcacccagaacuacaccaugaaccuggccagccagaacuggaacaacuacgaccccaccgaggagauccccgccccccugggcacccccgacuucgugggcaagauccagggcgugcugacccagaccaccagaggcgacggcagcaccagaggccacaaggccaccgugagcaccggcagcgugcacuucacccccaagcugggcagcgugcaguucagcaccgacaccagcaacgacuucgagaccggccagaacaccagauucacccccgugggcguggugcaggacggcagcaccacccaccagaacgagccccagcagugggugcugcccgacuacagcggcagaaacagccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggagagcgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagagcccuguga

SEQ ID NO: 23671 - RNA, 1623 nt, Artificial Sequence
  derived and/or modified sequence opt4 from capsid_protein__Norovirus__ABW74542
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccaggaguacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcgugcacuucacccccaagcugggcagaauccaguucagcaccgacaccagcaacgacuucgagaccggccagaacaccagauucacccccgugggcguggugcaggacggcagcaccacccaccagaacgagccccagcagugggugcugcccaacuacagcggcagagacagccacaacgugcaccuggcccccgccguggcccccagcuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23672 - RNA, 1623 nt, Artificial Sequence; identical to SEQ ID NO: 22522
  derived and/or modified sequence opt4 from capsid_protein__Norovirus__ABW74544

SEQ ID NO: 23673 - RNA, 1623 nt, Artificial Sequence; identical to SEQ ID NO: 23085
  derived and/or modified sequence opt4 from capsid_protein__Norovirus__ABW74545

SEQ ID NO: 23674 - RNA, 1623 nt, Artificial Sequence
  derived and/or modified sequence opt4 from capsid_protein__Norovirus__ABW74546
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuuccaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23675 - RNA, 1566 nt, Artificial Sequence
  derived and/or modified sequence opt4 from capsid_protein__Norovirus__ABW75843
augaagaugagcgacaaggagagcgccgagagccccgccagccugggccaggugcugcccccccagguggacgugguggugcccguggagcccaccgugggcgcccagaucgccgcccccaccgccggccagaucaaccccaucgaccccuggaucuucagcaacuucgugcaggccccccagggcgaguucaccaucagccccaacaacaaccccggcgagauccuguucgagauggagcugggccccgaccugaaccccuaccugggccaccugagaagaauguacaacggcuggaccggcagccugagagugagagugaugcuggccggcaacgccuucagcgccggcaagaucaucguguucugcaucccccccggcuucgacaccaccuuccugacccccgcccaggccacccaguucccccacgugaucauggacgugagagcccccgaccccguggaggugccccuggaggacgugagaaacgugcuguuccaccagggccccgacaacagaaugagacuggugggcaugcuguacaccccccugagagccaacagcggcgccgaccccuucguggugaccggcagagugcugaccugccccagcgagaacuucagcuucuucuuccuggugccccccaccguggaggagaaggacgugcccuucaccauccccaacgugcccaccagcagccugaccaacagcagaaugcuggagcccguggccgagcugagaagcagcagaaacuucgcccugagcgugcaguuccagaacggcagaagcaccaucgagggcgagcugcugggcaccacccccgccagccuggccgaccugggcagcuuccugugcaucagaggcggcaccgccaaccuggccgagcuguuccagcccaacgaggacgccuucguggccggcagccaccccgcccccuucggcuuccccgacuucagcaacugcacccuggacuuccugcuguacgacgccaacggccuguaccacagacaccuggacgugaccagcgccagcaacuucacccccgcccugggccacaucacccuggacggcagcgugcccgacagacugaccagagccagacuggagggcgugcagagagccagcgagaacaccuucuggagaaugcccgacuacagaggcgacgugcugggcgccgaguucgcccccgccgugagcgcccccggcaucggcgagacccugcuguucuucaugagcaacgugcccuaccacaacggcagcaaccccaacccccugcccugccugcugccccuggaguggaucaaccacuucguggccgagagacccgccaagcagagcgacguggcccugcugaacuacaucaacccccugaccggcagagugcuguucgagugcaagcuguacagcgccggcuuccuggccgugaaccugggcagccagaccgaggugacccugcccguggacggcaucuucaaguucgugagcugggugagcuacuacuaccagcugagacccgugggcaccgugagcgugggcagaagacugcccagacuggacggccacuga

SEQ ID NO: 23676 - RNA, 1737 nt, Artificial Sequence
  derived and/or modified sequence opt4 from capsid_protein__Norovirus__ABX71062
augaagauggccagcaacgacgccgcccccagcagcgacggcgccggcaaccuggugcccgagagccaccaggaggugcugccccuggcccccguggccggcgccgccaucgccgcccccguggugggccagcagaacaucaucgaccccuggaucaaggagaacuucgugcaggccccccagggcgaguucaccgugagccccaagaacagccccggcgaggugcuggugaaccuggagcugagccccaagcugaaccccuaccuggaccaccugagcaagauguacaacgccuacgccggcggcauggagaucgagaucauccuggccggcaacgccuucaccgccggcaaggugcugaucgccgccgugccccccaacuuccccguggagaacaucagcgugagccaggccagccaguucccccacgugaucguggacgugagaacccuggagcccaucagacugccccugcccgacgugagaaccaacuucuuccacuacaccaccagagacgagcccaagaugagaaucguggccuggcuguacaccccccugagaaccaacggcagcggcgacgacagcuucaccgugagcggcagaauccugaccagacccagcgccgacuucgaguucagcuuccuggugccccccaccguggagaccaagaccgugagcuucagcgugcccggccugaccguggaggagaugagcaacagcagauggcccgcccagaucaacggccugguggugagaggcaacgaggcccagguggugcacuuccagaacggcagaugcaccaccgagggcaugcugcugggcaccaccacccugaacgugaacagcaucugcggccugagaggcaccagcaucagccacgccagcgugagagaggcccccgcccugagcgaggagaugcccccccuggaggacgagguggcccacggcgccgccgccaccuacgccgugggcagagccgccgacaccacccuguggaucagaguggaggagcccaacggccagcccuacgacaucuucggcgagcagcccgccccccugggcacccccgacuucaccgccgugaucaucggcaccgccaucagacccagaaccgccagcggcgccuaccugcacgacgccuacguggacaccagacccggcgacgccgacuucacccccagcaccggcaacaccaagaucgugcugagaggcggcggcagcggccacgugggcgagggccacuacuggcaguucaagcccaucgccguggagggcggccccaacagacccguguaccaggaguacaaccugcccgaguacgccggccccaccgccagcaaccacaaccuggccccccccguggcccccaagaugcccggcgagcugcugcugcuguucgagagcgacaugcccgugugggacaacggcagcggcagcgcccccacccagaagauccacugccugcugcccaacgacuucgugacccacuucuucgaccugcaggcccccgcccuggccgaggccgcccugcugagauacgugcaccccgacagcggcagaacccuguucgagugcaagcuguacagagagggcuacaugguggugguggcccccagcggcagacuggacuucccccuggacggcuacuucagauucgacagcugggugaacgccuucuacgugcugagccccgugggcaacggccagggcagaagaggcagagccaagaacaucuga

SEQ ID NO: 23677 - RNA, 1605 nt, Artificial Sequence
  derived and/or modified sequence opt4 from capsid_protein__Norovirus__ABY77754
augaagauggccagcaacgacgccagccccagcagcgacggcagcgccaaccuggugcccgagaucaacaacgaggugauggcccuggagcccguggccggcgccgccaucgccgcccccguggccggccagcagaacaucaucgaccccuggaucagaaacaacuucgugcaggcccccggcggcgaguucaccgugagccccagaaacgcccccggcgaggugcugcugaaccugccccugagccccgacaucaaccccuaccuggcccaccugagcagaauguacaacggcuacgccggcggcguggagguggagguggugcuggccggcaacgccuucaccgccggcaagaucaucuucgccgccgugccccccaacuucccccccgagaaccugagccccagccagaucaccaugcugccccacaucaucguggacgugagacagcuggagcccgugagaaucccccugcccgacgugagaaacaacuucuaccacuacagcagagagaacgacagcacccugagacugguggccaugcuguacaccccccugagagccaacaacgccggcgacgacguguucaccgugagcugcagagugcugaccagacccagccccgacuucgacuucaucuuccuggugccccccaccguggagagcaagagcaagcccuucaccauccccauccugaccaucgaggagaugaccaacagcagauuccccgccccccuggagaugaugaccaccggccccagccacgacaucguggugcagccccagaacggcagaugcaccaucgacggcgugcugcugggcaccacccagcugagccccgugaacaucugcagcaugagaggcgugcccaccaagagaaccaacggcaccgacaacugcuucgugcagcuggagaaccccaacggcagcgccuacgaccccaccgaggacauccccgccgugcugggcagccccgacuucgugggcgaguucuacggcaccaucacccagagaagccccaacaacagcaccagagcccaccccuucacccugaacaccggcagccccagauacacccccaagaucggcagcguggacauccacgugaccgacguggacgaccugaacgaccacgagcccgugaagcugacccccgugggccugagcggcagcagcggcagcauccaccaguggcagcugcccaacuacagcggcguggccacccacaacaugcaccuggcccccagcguggccccccuguuccccggcgagcagauccuguucuucagaagcaccgugcccggcugcggcggcuaccccaacaccaacaucgacugccugaucccccaggagugggugcagcacuucuaccaggagggcgcccccgccagaaccgacguggcccugcugagauucaucaaccccgacaccggcagagugcuguucgagugcaagcugcacaagcacggcuucaucaccguggccuacagcggcaaccacgaccuggugaugccccccaacggcuacuucagauucgagagcugggugaaccaguuccacacccuggcccccaugggcaccggcagagccgaggagauccaguga

SEQ ID NO: 23678 - RNA, 1608 nt, Artificial Sequence
  derived and/or modified sequence opt4 from capsid_protein__Norovirus__ABZ89549
augaagauggccagcaacgacgccagccccagcagcgacggcagcgccaaccuggugcccgagaucaacaacgaggugauggcccuggagcccguggccggcgccgccaucgccgcccccguggccggccagcagaacaucaucgaccccuggaucagaaacaacuucgugcaggcccccggcggcgaguucaccgugagccccagaaacgcccccggcgaggugcugcugaaccugccccugagccccgacaucaaccccuaccuggcccaccugagcagaauguacaacggcuacgccggcggcguggagguggagguggugcuggccggcaacgccuucaccgccggcaagaucaucuucgccgccgugccccccaacuucccccccgagaaccugagccccagccagaucaccaugcugccccacaucaucguggacgugagacagcuggagcccgugagaaucccccugcccgacgugagaaacaacuucuaccacuacagcagagagaacgacagcacccugagacugaucgccaugcuguacaccccccugagagccaacaacgccggcgacgacguguucaccgugagcugcagagugcugaccagacccagccccgacuucgacuucaucuuccuggugccccccaccguggagagcaagagcaagcccuucaccauccccauccugaccaucgaggagaugaccaacagcagauuccccgccccccuggagaugaugaccaccggccccagccacgacaucguggugcagccccagaacggcagaugcaccaucgacggcgugcugcugggcaccacccagcugagccccgugaacaucugcagcaugagaggcgugcccaccaagagaaccaacggcaccgacaacugcuucgugcagcuggagaaccccaacggcagcgccuacgaccccaccgaggacauccccgccgugcugggcagccccgacuucgugggcgaguucuacggcaccaucacccagagaagccccaacaacagcaccagagcccaccccuucacccugaacaccggcagccccagauacacccccaagaucggcagcguggacauccacgugaccgacguggaggaccugaacgaccacgagcccgugaagcugacccccgugggccugagcggcagcagcggcagcauccaccaguggcagcugcccaacuacagcggcguggccacccacaacaugcaccuggcccccagcguggccccccuguuccccggcgagcagauccuguucuucagaagcaccgugcccggcugcggcggcuaccccaacaccaacaucgacugccugaucccccaggagugggugcagcacuucuaccaggagggcgcccccgccagaaccgacguggcccugcugagauucgugaaccccgacaccggcagagugcuguucgagugcaagcugcacaagcacggcuucaucaccguggccuacagcggcaaccacgaccuggugaugccccccaacggcuacuucagauucgagagcugggugaaccaguuccacacccuggcccccaugggcaccggcagcggcagaagaagaauccaguga

SEQ ID NO: 23679 - RNA, 1644 nt, Artificial Sequence
  derived and/or modified sequence opt4 from capsid_protein__Norovirus__ACC69023
augaagauggccagcaacgacgccccccccagcaccgacggcagcgccggccuggugcccgaggugaacaacgagaccauggcccuggagcccguggugggcgccccccuggccgcccccguggccggccagcacaacaucaucgaccccuggaucaagaugaacuucgugcaggcccccaacggcgaguucaccgugagccccagaaacgcccccggcgagauccugcuggaccuggagcugggccccgaccugaaccccuaccugagccaccuggccagaauguacaacggcuacgccggcggcauggaggcccagguggugcuggccggcaacgccuucaccgccggcaagaucaucuucgccgccgugccccccaacuuccccgccgagaaccugagcgccgcccaggugaccaugugcccccacgugaucguggacgugagacagcuggagcccgugaugcugcccaugcccgacaucagaaacaagcuguuccacuacaaccagguggacgaccccaagcugagacugcuggccuaccuguacaccccccugagagccaacaacgccggcgacgacguguucaccgugagcugcagagugcugaccagacccacccccgacuucgaguucauguuccuggugccccccaccguggagagcaagaccaagcccuucagccugcccggccugacccuggacgagcugagcaacagcagauuccccgcccccaucgugcagcuguacaccaacccccacgacaaccugguggugcagccccagaacggcagaugcaccaucgacggccugcugcagggcaccacccagcuggugagcugcaacgugugcagcuacagaggcaccaucggcggcggccagcccgccagccacaccgaggaggagaucaugcccauggccuucaacauccagagagagaucaugcuggagaaccuggacggcagccccuacgaccccguggacgacauccccgccgugcugggcagccccgacuuccagggcgugguguucggcauccugagccagagaaacgccaacggccagaccagagcccacgaggccaagguggacaccagagccgccagauucgcccccaagcugggcuucgugguggccaccguggagagcaccgacuuccacgacaaccagcccagcagauucgcccccgugggccugggcggcaacggcaaccaggacuucaaccagugggcccugcccgccuacggcggcgcccugaccaacaacaccaaccuggccccccccgugaugcccguguaccccggcgagcagcugcuguucuucagaagccagcugcccagcagcggcggcguggugggcggcuggcuggacugccugcugccccaggagugggugcagcacuucuuccaggagagcgccaccagccagagcgacguggcccuggugagauacaucaaccccaccaccggcagagugcuguucgaggccaagcugcacaagcagggcuuccugaccguggccgccagcggcagcuacccccugguggugcccgccgacggcuacuucagauucgagagcugggugaaccaguucuacacccuggcccccaugggcaacggcagcggcagaagaagagccagauga

SEQ ID NO: 23680 - RNA, 1644 nt, Artificial Sequence
  derived and/or modified sequence opt4 from capsid_protein__Norovirus__ACC69026
augaagauggccagcaacgacgccccccccagcaccgacggcagcgccggccuggugcccgaggugaacaacgagaccauggcccuggagcccguggugggcgccccccuggccgcccccguggccggccagcacaacaucaucgaccccuggaucaagaugaacuucgugcaggcccccaacggcgaguucaccgugagccccagaaacgcccccggcgagauccugcuggaccuggagcugggccccgaccugaaccccuaccugagccaccuggccagaauguacaacggcuacgccggcggcauggaggugcagguggugcuggccggcaacgccuucaccgccggcaagaucaucuucgccgccgugccccccaacuuccccgccgagaaccugagcgccgcccaggugaccaugugcccccacgugaucguggacgugagacagcuggagcccgugaugcugcccaugcccgacaucagaaacaagcuguuccacuacaaccagguggacgaccccaagcugagacugcuggccuaccuguacaccccccugagagccaacaacgccggcgacgacguguucaccgugagcugcagagugcugaccagacccacccccgacuucgaguucauguuccuggugccccccaccguggagagcaagaccaagcccuucagccugcccggccugacccuggacgagcugagcaacagcagauuccccgcccccaucgugcagcuguacaccaacccccacgacaaccugguggugcagccccagaacggcagaugcaccaucgacggccugcugcagggcaccacccagcuggugagcugcaacgugugcagcuucagaggcaccaucggcggcggccagcccgccagccacagcgaggaggagaucaugcccauggccuucaacauccagagagagaucaugcuggagaaccuggacggcagccccuacgaccccgccgacgacauccccgccgugcugggcagccccgacuuccagggcgugguguucggcauccugagccagagaaacgccagcggccagaccagagcccacgaggccaagguggacaccagagccgccagauucgcccccaagcugggcuucgugguggccaccguggagagcaccgacuuccacgacaaccagcccagcagauucacccccgugggccugggcggcaacggcaaccaggacuucaaccagugggcccugcccgccuacggcggcgcccugaccaacaacaccaaccuggccccccccgugaugcccguguaccccggcgagcagcugcuguucuucagaagccagcugcccagcagcggcggcguggugggcggcuggcuggacugccugcugccccaggagugggugcagcacuucuuccaggagagcgccaccagccagagcgacguggcccuggugagauacaucaaccccaccaccggcagagugcuguucgaggccaagcugcacaagcagggcuuccugaccguggccgccagcggcagcuacccccugguggugcccgccgacggcuacuucagauucgagagcugggugaaccaguucuacacccuggcccccaugggcaacggcagcggcagaagaagagccagauga

SEQ ID NO: 23681 - RNA, 1671 nt, Artificial Sequence
  derived and/or modified sequence opt4 from capsid_protein__Norovirus__ACC69028
augaagauggccagcaacgacguggccgcccccagcaccgacggcagcgccggccuggugcccgaggugaacaacgagaccauggcccuggagcccguggccggcgccgcccuggccgcccccguggugggccagcacaacgugaucgaccccuggaucagaggcaacuucgugcaggcccccaacggcgaguucaccgugagccccagaaacagccccggcgaggugcugcugaaccuggagcugggccccgagcugaaccccuaccuggcccaccuggccagaauguacaacggcuacgccggcggcauggaggugcagguggugcuggccggcaacgccuucgccgccggcaagaucaucuucgccgccgugccccccagcuuccccguggacgcccugagcgcccccaccaucaccaugugcccccacgugaucguggacgugagacagcuggagcccgugcugcugcccaugcccgacgugagaaacaacuucuuccacuacaaccagagcagcgaccccaagcugagacugguggccaugcuguacaccccccugagagccaacagccccaccgacgacguguucaccgugagcugcagagugcugaccagacccagccccgacuucgaguucaccuuccugaucccccccaccguggagagcaagagcaagccccugaccaucccccagcugacccugagcgagcugagcaacagcagauuccccgcccccaucgacaugcugaacaccagccccaacgacaacaucguggugcagccccagaacggcagaugcacccuggacggcgagcugcagggcaccacccagcugcagcccagccugaucugcagcuucagaggcguggugcugaacgagaccagcagaauggccguggacuacgaggaggaggaggaggugcagagaccccaggccagagccuucaaccacgaguaccaccugcagcugcagaaccuggacggcaccgacuacgaccccgccggcgaccugcccgccacccugggcgcccccgacuucgugggcaccguguacggcguggugagccagagaaccaccagagacagcgccgccagagcccacgaggccaagaucaucaccaacgaccccagauacgcccccaagcugggcagcguggaguucgugaccgagagcaccgacaucgugaucaacgaccagaccaaguucacccccgugggccuggcccacaacagagccguggacuacaagcagugggagcugccccacuacgccggcgagcugaccgccaacaccaaccuggccccccccguggcccccguguaccccggcgagcagcugcuguucuucagaagcaaccugccccuggccggcggcaccgccgccagcgugcuggacuaccugcugccccaggaguggauccagcacuucuaccaggagagcuucaccccccagagcgacaucgcccugcugagauacgugaaccccgacaccggcagagugcuguucgaggccaagcugcacagacagggcuacaucaccguggccggcgccggcaccagccccguggccgugccccccaacggcuacuucagauucgagagcugggugagccaguucuacgcccuggcccccaugggcagcggcaccggcagaagaagaaaccaguga

SEQ ID NO: 23682 - RNA, 1626 nt, Artificial Sequence
  derived and/or modified sequence opt4 from capsid_protein__Norovirus__ACC96732
augggcaugagcgacggcgccgcccccaaggccaacggcagcgaggccagcggccaggaccuggugcccaccgccguggagcaggccgugcccauccagcccguggccggcgccgcccuggccgcccccgccgccggccagaucaaccagaucgaccccuggaucuuccagaacuucgugcagugcccccugggcgaguucagcaucagccccagaaacacccccggcgagauccuguucgaccuggcccugggccccggccugaaccccuaccuggcccaccugagcgccauguacaccggcugggugggcaacauggaggugcagcuggugcuggccggcaacgccuucaccgccggcaagguggugguggcccuggugccccccuacuuccccaagggcagccugaccaccgcccagaucaccugcuucccccacgugaugugcgacgugagaacccuggagcccauccagcugccccugcuggacgugagaagagugcuguggcacgccacccaggaccaggaggagagcaugagacuggugugcaugcuguacaccccccugagaaccaacagccccggcgacgagagcuucguggugagcggcagacugcugagcaagcccgccgccgacuucaacuucguguaccugaccccccccaucgagagaaccaucuacagaaugguggaccugcccgugauccagcccagacugugcaccagagccagauggcccgcccccguguacggccugcugguggaccccagccugcccagcaacccccaguggcagaacggcagagugcacguggacggcacccugcugggcaccacccccaucagcggcagcugggugagcugcuucgccgccgaggccgccuacgaguucagaagcggcaccggcgaggaggugaccuucacccugaucgagcaggacggcagcgccuacgugcccggcgacagagccgccccccugggcuaccccgacuucagcggccagcuggagaucgaggugcagaccgagaccaccaagaccggcgacaagcugaaggugaccaccuucgagaugauccugggccccagaaccaacguggaccaggcccccuaccagggcagagccuacgccagcgugaacgccaccgccagccugaaccugguggacggcagagugagagccgugcccagaagcauccacagcuuccaggacgugauccccgaguacaacgacggccugcuggugccccuggccccccccaucggccccuuccugcccagcgaggugcugcugagauucagaaccuacaugagacagaucgacaccgccgacgccgccgccgaggccaucgacugcgcccugccccaggaguucgugagcugguucgccagcaacgccuucaccgugcagagcgaggcccugcugcugagauacagaaacacccugaccggccagcugcuguucgagugcaagcuguacagcgagggcuacaucgcccugagcuacagcggcagcggcccccugaccuuccccaccgacggcuucuucgagguggugagcugggugcccagacuguaccagcuggccagcgugggcagccuggccaccggcagaacccugaagcaguga

SEQ ID NO: 23683 - RNA, 1626 nt, Artificial Sequence
  derived and/or modified sequence opt4 from capsid_protein__Norovirus__ACC96735
augagaaugagcgacggcgccgcccccaaggccaacggcagcgaggccagcggccaggaccuggugcccaccgccguggagcaggccgugcccauccagcccguggccggcgccgcccuggccgcccccgccgccggccagaucaaccagaucgaccccuggaucuuccagaacuucgugcagugcccccugggcgaguucagcaucagccccagaaacacccccggcgagauccuguucgaccuggcccugggccccggccugaaccccuaccuggcccaccugagcgccauguacaccggcugggugggcaacauggaggugcagcuggugcuggccggcaacgccuucaccgccggcaagguggugguggcccuggugccccccuacuuccccagaggcagccugaccaccacccagaucaccugcuucccccacgugaugugcgacgugagaacccuggagcccauccagcugccccugcuggacgugagaagagugcuguggcacgccacccaggaccaggaggagagcaugagacuggugugcaugcuguacaccccccugagaaccaacagccccggcgacgagagcuucguggugagcggcagacugcugagcaagcccgccgccgacuucaacuucguguaccugaccccccccaucgagagaaccaucuacagaaugguggaccugcccguggugcagcccagacugugcacccacgccagauggcccgcccccaucuacggccugcugguggaccccagccugcccagcaacccccaguggcagaacggcagagugcacguggacggcacccugcugggcaccacccccaucagcggcagcugggugagcugcuucgccgccgaggccgccuacgaguuccagagcggcaccggcgagguggccaccuucacccugaucgagcaggacggcagcgccuacgugcccggcgacagagccgccccccugggcuaccccgacuucagcggccagcuggagaucgaggugcagaccgagaccaccaagaccggcgacaagcugaaggugaccaccuucgagaugauccugggccccgagaccaacgaggaccaggcccccuaccagggcagaguguucgccagcaucagcgccgccgccagccuggaccugguggacggcagagugagagccgugcccagaagcaucuacggcuuccaggacgugauccccgaguacaacgacggccugcuggugccccuggccccccccaucggccccuuccugcccggcgaggugcugcugagauucagaaccuacaugagacagguggacacccaggacgccgccgccgaggccaucgacugcgcccugccccaggaguucgugagcugguucgccagcaacgccuucaccgugcagagcgaggcccugcugcugagauacagaaacacccugaccggccagcugcuguucgagugcaagcuguacagcgagggcuacaucgcccugagcuacagcggccccggcccccugaccuuccccagcaacggcuucuucgagguggugagcugggugcccagacuguaccagcuggccagcgugggcagccuggccaccggcagaacccugaagcaguga

SEQ ID NO: 23684 - RNA, 1623 nt, Artificial Sequence
  derived and/or modified sequence opt4 from capsid_protein__Norovirus__ACF41177
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcagcuucagaggcgacgugacccacauccccggcaccagaaccuacagaaugaaccuggccagccagaacuggaacaacuacgaccccaccgaggagauccccgccccccugggcacccccgacuucgugggcaagauccagggcaugcugacccagaccaccaagggcgacggcagcaccagaggccacaaggccaccgugagcaccggcagcguggacuucacccccaagcugggcagcgugcaguucgccaccgacaccgacaacgacuucgagaccggccagaacaccagauucacccccgugggcgugauccaggacggcagcagcacccacagaaacgagccccagcagugggugcugcccgacuacagcggcagaaccgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccagccagagcgacguggcccugcugagauucgugaaccccgacaccggcagagugcuguucgagugcaagcugcacaaggccggcuacgugaccguggcccacaccggccagcacgaccuggugaucccccccaacggcuacuucagauucgacagcugggugaaccaguucuacacccuggcccccaugggcaacggcgccggcagaagaagagccagcuga

SEQ ID NO: 23685 - RNA, 1623 nt, Artificial Sequence
  derived and/or modified sequence opt4 from capsid_protein__Norovirus__ACF41180
augaagauggccagcaacgacgccacccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccagaacuacaccaugaaccuggccagccagaacuggaacaacuacgaccccaccgaggagauccccgccccccugggcacccccgacuucgugggcaagauccagggcgugcugacccagaccaccaagagagacggcagcaccagaggccacaaggccaccgugagcaccggcagcgugcacuucacccccaagcugggcagcgugcaguucagcaccgacaccagcaacgacuucgagaucggccagaacaccagauucacccccgugggcguggugcaggacggcagcaccacccaccagaacgagccccagcagugggugcugcccaacuacagcggcagagacggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggagagcgcccccgcccagagcgacguggcccugcugagauucgugaaccccgacaccggcagagcccuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagagcccuguga

SEQ ID NO: 23686 - RNA, 1623 nt, Artificial Sequence
  derived and/or modified sequence opt4 from capsid_protein__Norovirus__ACF41181
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcaccagaaccuacagaaugaaccuggccagccagaacuggaacaacuacgaccccaccgaggagauccccgccccccugggcacccccgacuucgugggcaagauccagggcaugcugccccagaccaccaagggcgacggcagcaccagaggccacaaggccaccgugagcaccggcagcguggacuucacccccaagcugggcagcgugcaguucgccaccgacaccgacaacgacuucgagaccggccagaacaccagauucacccccgugggcgugauccaggacggcagcagcacccacagaaacgagccccagcagugggugcugcccgacuacagcggcagaaccguguacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccagccagagcgacguggcccugcugagauucgugaaccccgacaccggcagagugcuguucgagugcaagcugcacaaggccggcuacgugaccguggcccacaccggccagcacgaccuggugaucccccccaacggcuacuucagauucgacagcugggugaaccaguucuacacccuggcccccaugggcaacggcgccggcagaagaagagcccuguga

SEQ ID NO: 23687 - RNA, 1623 nt, Artificial Sequence
  derived and/or modified sequence opt4 from capsid_protein__Norovirus__ACF41182
augaagauggccagcaacgacgccagccccagcgacggcagcaccgccaaccuggugcccgaggugaacaacgaggugauggcccuggagcccguggugggcgccgccaucgccgcccccgugaccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcaccagaaccuacagaaugaaccuggccagccagaacuggaacaacuacgaccccaccgaggagauccccgccccccugggcacccccgacuucgugggcaagauccagggcaugcugacccagaccaccaagggcgacggcagcaccagaggccacaaggccaccgugagcaccggcagcguggacuucacccccaagcugggcagcgugcaguucgccaccgacaccgacaacgacuucgagaccggccagaacaccagauucacccccgugggcgugauccaggacggcagcagcacccacagaaacgagccccagcagugggugcugcccgacuacagcggcagaaccgcccacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccagccagagcgacguggcccugcugagauucgugaaccccgacaccggcagagugcuguucgagugcaagcugcacaaggccggcuacgugaccguggcccacaccggccagcacgaccuggugaucccccccaacggcuacuucagauucgacagcugggugaaccaguucuacacccuggcccccaugggcaacggcgccggcagaagaagagcccuguga

SEQ ID NO: 23688 - RNA, 1623 nt, Artificial Sequence
  derived and/or modified sequence opt4 from capsid_protein__Norovirus__ACF41183
augaagauggccagcaacgacgccagccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcaccagagccuacagaaugaaccuggccagccagaacuggaacaacuacgaccccaccgaggagauccccgccccccugggcacccccgacuucgugggcaagauccagggcaugcugacccagaccaccaagggcgacggcagcaccagaggccacaaggccaccgugagcaccggcagcguggacuucacccccaagcugggcagcgugcaguucgccaccgacaccgacaacgacuucgagaccggccagaacaccagauucacccccgugggcgugauccaggacggcagcagcacccacagaaacgagccccagcagugggugcugcccgacuacagcggcagaaccgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccagccagagcgacguggcccugcugagauucgugaaccccgacaccggcagagugcuguucgagugcaagcugcacaaggccggcuacgugaccguggcccacaccggccagcacgaccuggugaucccccccaacggcuacuucagauucgacagcugggugaaccaguucuacacccuggcccccaugggcaacggcgccggcagaagaagagcccuguga

SEQ ID NO: 23689 - RNA, 1623 nt, Artificial Sequence
  derived and/or modified sequence opt4 from capsid_protein__Norovirus__ACF41184
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccuggccguggaggagaugaccaacagcagauuccccaucccccuggagaagcuguucaccggccccagcagcgcccugguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucggcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23690 - RNA, 1623 nt, Artificial Sequence
  derived and/or modified sequence opt4 from capsid_protein__Norovirus__ACF41185
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagagacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagaaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23691 - RNA, 1623 nt, Artificial Sequence
  derived and/or modified sequence opt4 from capsid_protein__Norovirus__ACF41186
augaagauggccagcaacgacgccaaccccagcggcggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccaggacaccaaguucacccccgugggcgugauccaggacggcggcaccacccacagaaacgagccccagcagugggugcugcccagcuacagcggcagaaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23692 - RNA, 1623 nt, Artificial Sequence
  derived and/or modified sequence opt4 from capsid_protein__Norovirus__ACF41187
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagaucagaggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23693 - RNA, 1623 nt, Artificial Sequence
  derived and/or modified sequence opt4 from capsid_protein__Norovirus__ACF41188
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccgccuacaccggcagcgcccccuucacccccaagcugggcagcgugcaguucagcaccgacaccgagaacgacuucgagacccaccagaacaccaaguucgcccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23694 - RNA, 1623 nt, Artificial Sequence; identical to SEQ ID NO: 22671
  derived and/or modified sequence opt4 from capsid_protein__Norovirus__ACF41190

SEQ ID NO: 23695 - RNA, 1623 nt, Artificial Sequence
  derived and/or modified sequence opt4 from capsid_protein__Norovirus__ACF41191
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccggcuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23696 - RNA, 1647 nt, Artificial Sequence
  derived and/or modified sequence opt4 from capsid_protein__Norovirus__ACF60293
augaagauggccagcaacgacgccacccccagcaacgacggcgccgccggccuggugcccgagaucaacaacgaggccauggcccuggaccccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgccuucaccgccggcaagaucaucuucgccgccaucccccccaacuuccccaucgagaaccugagcgccgcccagaucaccaugugcccccacgugaucguggacgugagacagcuggagcccgugaaccugcccaugcccgacgugagaaacaacuucuuccacuacaaccagggcagcgacagcaagcugagacugguggccaugcuguacaccccccugagagccaacaacagcggcgacgacguguucaccgugagcugcagagugcugaccagacccagccccgacuucagcuucaacuuccuggugccccccaccguggagagcaagaccaagcccuucacccugcccauccugaccaucagcgagaugagcaacagcagauuccccgugcccaucgacagccugcacaccagccccaccgagaacaucguggugcagugccagaacggcagagugacccuggacggcgagcugaugggcaccacccagcugcugcccagccagaucugcgccuucagaggcgugcugaccagaagcaccagcagagccagcgaccaggccgacaccgccacccccagacuguucaacuacuacuggcacauccagcuggacaaccugaacggcacccccuacgaccccgccgaggacauccccggcccccugggcacccccgacuucagaggcaagguguucggcguggccagccagagaaaccccgacagcaccaccagagcccacgaggccaagguggacaccaccgccggcagauucacccccaagcugggcagccuggagaucagcaccgagagcggcgacuucgaccagaaccagcccaccagauucacccccgugggcaucggcguggaccacgaggccgacuuccagcaguggagccugcccgacuacagcggccaguucacccacaacaugaaccuggcccccgccguggcccccaacuuccccggcgagcagcugcuguucuucagaagccagcugcccagcagcggcggcagaagcaacggcauccuggacugcagagugccccaggagugggugcagcacuucuaccaggagagcgcccccgcccagacccagguggcccuggugagauacgugaaccccgacaccggcagagugcuguucgaggccaagcugcacaagcugggcuucaugaccaucgccaagaacggcgacagccccaucaccgugccccccaacggcuacuucagauucgagagcugggugaaccccuucuacacccuggcccccaugggcaccggcaacggcagaagaagaauccaguga

SEQ ID NO: 23697 - RNA, 1647 nt, Artificial Sequence
  derived and/or modified sequence opt4 from capsid_protein__Norovirus__ACF60294
augaagauggccagcaacgacgccacccccagcaacgacggcgccgccggccuggugcccgagaucaacaacgaggccauggcccuggaccccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgccuucaccgccggcaagaucaucuucgccgccaucccccccaacuuccccaucgacaaccugagcgccgcccagaucaccaugugcccccacgugaucguggacgugagacagcuggagcccgugaaccugcccaugcccgacgugagaaacaacuucuuccacuacaaccagggcagcgacagcagacugagacugguggccaugcuguacaccccccugagagccaacaacagcggcgacgacguguucaccgugagcugcagagugcugaccagacccagccccgacuucagcuucaacuuccuggugccccccaccguggagagcaagaccaagcccuucacccugcccauccugaccaucagcgagaugagcaacagcagauuccccgugcccaucgacagccugcacaccagccccaccgagaacaucguggugcagugccagaacggcagagugacccuggacggcgagcugaugggcaccacccagcugcugcccagccagaucugcgccuucagaggcgugcugaccagaagcaccagcagagccagcgaccaggccgacaccgccacccccagacuguucaacuacuacuggcacauccagcuggacaaccugaacggcacccccuacgaccccgccgaggacauccccggcccccugggcacccccgacuucagaggcaagguguucggcguggccagccagagaaaccccgacagcaccaccagagcccacgaggccaagguggacaccaccgccggcagauucacccccaagcugggcagccuggagaucagcaccgagagcggcgacuucgaccagaaccagcccaccagauucacccccgugggcaucggcguggaccacgaggccgacuuccagcaguggagccugcccgacuacagcggccaguucacccacaacaugaaccuggcccccgccguggcccccaacuuccccggcgagcagcugcuguucuucagaagccagcugcccagcagcggcggcagaagcaacggcauccuggacugccuggugccccaggagugggugcagcacuucuaccaggagagcgcccccgcccagacccagguggcccuggugagauacgugaaccccgacaccggcagagugcuguucgaggccaagcugcacaagcugggcuucaugaccaucgccaagaacggcgacagccccaucaccgugccccccaacggcuacuucagauucgagagcugggugaaccccuucuacacccuggcccccaugggcaccggcaacggcagaagaagaauccaguga

SEQ ID NO: 23698 - RNA, 1647 nt, Artificial Sequence
  derived and/or modified sequence opt4 from capsid_protein__Norovirus__ACF60295
augaagauggccagcaacgacgccacccccagcaacgacggcgccgccggccuggugcccgagaucaacaacgaggccauggcccuggaccccguggccggcgccgccaucgccgccccccugaccggccagcagaacaucaucgaccccuggaucaugaacaacuucgugcaggcccccggcggcgaguucaccgugagccccagaaacagccccggcgaggugccccugaaccuggagcugggccccgagaucaaccccuaccuggcccaccuggccagaauguacaacggcuacgccggcggcuucgaggugcagguggugcuggccggcaacgccuucaccgccggcaagaucaucuucgccgccaucccccccaacuuccccaccgacaaccugagcgccgcccagaucaccaugugcccccacgugaucguggacgugagacagcuggagcccgugaaccugcccaugcccgacgugagaaacaacuucuuccacuacaaccagggcagcgacagcagacugagacugguggccaugcuguacaccccccugagagccaacaacagcggcgacgacguguucaccgugagcugcagagugcugaccagacccagccccgacuucagcuucaacuuccuggugccccccaccguggagagcaagaccaagcccuucacccugcccauccugaccaucagcgagaugagcaacagcagauuccccgugcccaucgacagccugcacaccagccccaccgagaacaucguggugcagugccagaacggcagagugacccuggacggcgagcugaugggcaccacccagcugcugcccagccagaucugcgccuucagaggcgugcugaccagaagcaccagcagagccagcgaccaggccgacaccgccacccccagacuguucaacuacuacuggcacauccagcuggacaaccugaacggcacccccuacgaccccgccgaggacauccccggcccccugggcacccccgacuucagaggcaagguguucggcguggccagccagagaaaccccgacagcaccaccagagcccacgaggccaagguggacaccaccgccggcagauucacccccaagcugggcagccuggagaucagcaccgagagcgacgacuucgaccagaaccagcccaccagauucacccccgugggcaucggcguggaccacgaggccgacuuccagcaguggagccugcccgacuacagcggccaguucacccacaacaugaaccuggcccccgccguggcccccaacuuccccggcgagcagcugcuguucuucagaagccagcugcccagcagcggcggcagaagcaacggcauccuggacugccuggugccccaggagugggugcagcacuucuaccaggagagcgcccccgcccagacccagguggcccuggugagauacgugaaccccgacaccggcagagugcuguucgaggccaagcugcacaagcugggcuucaugaccaucgccaagaacggcgacagccccaucaccgugccccccaacggcuacuucagauucgagagcugggugaaccccuucuacacccuggcccccaugggcaccggcaacggcagaagaagaauccaguga

SEQ ID NO: 23699 - RNA, 1647 nt, Artificial Sequence
  derived and/or modified sequence opt4 from capsid_protein__Norovirus__ACF60296
augaagauggccagcaacgacgccacccccagcaacgacggcgccgccggccuggugcccgagaucaacaacgaggccauggcccuggaccccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgccuucaccgccggcaagaucaucuucgccgccaucccccccaacuuccccaucgacaaccugagcgccgcccagaucaccaugugcccccacgugaucguggacgugagacagcuggagcccgugaaccugcccaugcccgacgugagaaacaacuucuuccacuacaaccagggcagcgacagcagacugagacugguggccaugcuguacaccccccugagagccaacaacagcggcgacgacguguucaccgugagcugcagagugcugaccagacccagccccgacuucagcuucaacuuccuggugccccccaccguggagagcaagaccaagcccuucacccugcccauccugaccaucagcgagaugagcaacagcagauuccccgugcccaucgacagccugcacaccagccccaccgagaacaucguggugcagugccagaacggcagagugacccuggacggcgagcugaugggcaccacccagcugcugcccagccagaucugcgccuucagaggcgugcugaccagaagcaccagcagagccagcgaccaggccgacaccgccacccccagacuguucaacuacuacuggcacauccagcuggacaaccugaacggcacccccuacgaccccgccgaggacauccccggcccccugggcacccccgacuucagaggcaagguguucggcguggccagccagagaaaccccgacagcaccaccagagcccacgaggccaagguggacaccaccgccggcagauucacccccaagcugggcagccuggagaucagcaccgagagcgacgacuucgaccagaaccagcccaccagauucacccccgugggcaucggcguggaccacgaggccgacuuccagcaguggagccugcccgacuacagcggccaguucacccacaacaugaaccuggcccccgccguggcccccaacuuccccggcgagcagcugcuguucuucagaagccagcugcccagcagcggcggcagaagcaacggcauccuggacugccuggugccccaggagugggugcagcacuucuaccaggagagcgcccccgcccagacccagguggcccuggugagauacgugaaccccgacaccggcagagugcuguucgaggccaagcugcacaagcugggcuucaugaccaucgccaagaacggcgacagccccaucaccgugccccccaacggcuacuucagauucgagagcugggugaaccccuucuacacccuggcccccaugggcaccggcaacggcagaagaagaauccaguga

SEQ ID NO: 23700 - RNA, 1647 nt, Artificial Sequence
  derived and/or modified sequence opt4 from capsid_protein__Norovirus__ACF60297
augaagauggccagcaacgacgccacccccagcaacgacggcgccgccggccuggugcccgagaucaacaacgaggccauggcccuggaccccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgccuucaccgccggcaagaucaucuucgccgccaucccccccaacuuccccaucgacaaccugagcgccgcccagaucaccaugugcccccacgugaucguggacgugagacagcuggagcccgugaaccugcccaugcccgacgugagaaacaacuucuuccacuacaaccagggcagcgacagcagacugagacugguggccaugcuguacaccccccugagagccaacaacagcggcgacgacguguucaccgugagcugcagagugcugaccagacccagccccgacuucagcuucaacuuccuggugccccccaccguggagagcaagaccaagcccuucacccugcccauccugaccaucagcgagaugagcaacagcagauuccccgugcccaucgacagccuguacaccagccccaccgagaacaucguggugcagugccagaacggcagagugacccuggacggcgagcuggugggcaccacccagcugcugcccagccagaucugcgccuucagaggcgugcugaccagaagcaccagcagagccagcgaccaggccgacaccgccacccccagacuguucaacuacuacuggcacauccagcuggacaaccugaacggcacccccuacgaccccgccgaggacauccccggcccccugggcacccccgacuucagaggcaagguguucggcguggccagccagagaaaccccgacagcaccaccagagcccacgaggccaagguggacaccaccgccggcagauucacccccaagcugggcagccuggagaucagcaccgagagcggcgacuucgaccagaaccagcccaccagauucacccccgugggcaucggcguggaccacgaggccgacuuccagcaguggagccugcccgacuacagcggccaguucacccacaacaugaaccuggcccccgccguggcccccaacuuccccggcgagcagcugcuguucuucagaagccagcugcccagcagcggcggcagaagcaacggcauccuggacugccuggugccccaggagugggugcagcacuucuaccaggagagcgcccccgcccagacccagguggcccuggugagauacgugaaccccgacaccggcagagugcuguucgaggccaagcugcacaagcugggcuucaugaccaucgccaagaacggcgacagccccaucaccgugccccccaacggcuacuucagauucgagagcugggugaaccccuucuacacccuggcccccaugggcaccggcaacggcagaagaagaauccaguga

SEQ ID NO: 23701 - RNA, 1626 nt, Artificial Sequence
  derived and/or modified sequence opt4 from capsid_protein__Norovirus__ACF72688
augagaaugagcgacggcgccgcccccaaggccaacggcagcgaggccagcggccaggaccuggugcccaccgccguggagcaggccgugcccauccagcccguggccggcgccgcccuggccgcccccgccgccggccagaucaaccagaucgaccccuggaucuuccagaacuucgugcagugcccccugggcgaguucagcaucagccccagaaacacccccggcgagauccuguucgaccuggcccugggccccggccugaaccccuaccuggcccaccugagcgccauguacaccggcugggugggcaacauggaggugcagcuggugcuggccggcaacgccuucaccgccggcaagguggugguggcccuggugccccccuacuucagcaagggcagccugaccaccgcccagaucaccugcuucccccacgugaugugcgacgugagaacccuggagcccauccagcugccccugcuggacgugagaagagugcuguggcacgccacccaggaccaggaggagagcaugagacuggugugcaugcuguacaccccccugagaaccaacagccccggcgacgagagcuucguggugagcggcagacugcugagcaagcccgcccccgacuucaacuucguguaccugaccccccccaucgagagaaccaucuacagaaugguggaccugccccugcugcagcccagacugugcacccacgccagauggcccgcccccguguacggccugcugguggaccccagccugcccagcaacccccaguggcagaacggcagagugcacguggacggcacccugcugggcaccacccccgugagcggcagcugggugagcugcuucgccgccgaggccgccuacgaguuccagagcggcaucggcgagguggugaccuucaccaugaucgagcaggacggcagcgccuacgugcccggcgacagagccgccccccugggcuaccccgacuucagcggccagcuggagaucgaggugcagaccgagaccaccaagaccggcgacaagcugaaggugaccaccuucgagaugauccugggccccaccaccaacguggaccaggcccccuaccagggcagagccuacgccagccugaccgccauggccagccuggaccugguggacggcagagugagagccgugcccagaagcaucuacagcuuccaggacgagcugcccgaguacaacgacggccugcuggugccccuggcccccccccugggccccuuccugcccggcgaggugcugcugagauucagaaccuacaugagacagcuggacaccgccgacgccgccgcccagcccaucgacugcgcccugccccaggaguucaucagcugguucgccagcaacaacuucaccgugcagagcgacgcccugcuggugagauacagaaacacccugaccggccagcugcuguucgaggccaagcuguacagcgagggcuacaucgccgugagcuacagcggcagcggcccccugaccuuccccaccgacggcuucuucgagguggugagcugggugcccagacuguuccagcuggccagcgugggcagccuggccaccggcagaacccugaagcaguga

SEQ ID NO: 23702 - RNA, 1623 nt, Artificial Sequence
  derived and/or modified sequence opt4 from capsid_protein__Norovirus__ACH42093
augaagauggccagcaacgacgccacccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccagaacuacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcgugcacuucacccccaagcugggcagcgugcaguucagcaccgacaccagcaacgacuucgagaccggccagaacaccaaguucacccccgugggcguggugcaggacggcagcaccacccaccagaacgagccccagcagugggugcugcccgacuacagcggcagagacagccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggagagcgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagagcccuguga

SEQ ID NO: 23703 - RNA, 1623 nt, Artificial Sequence; identical to SEQ ID NO: 22537
  derived and/or modified sequence opt4 from capsid_protein__Norovirus__ACH42094

SEQ ID NO: 23704 - RNA, 1623 nt, Artificial Sequence; identical to SEQ ID NO: 22537
  derived and/or modified sequence opt4 from capsid_protein__Norovirus__ACH42096

SEQ ID NO: 23705 - RNA, 1623 nt, Artificial Sequence; identical to SEQ ID NO: 22537
  derived and/or modified sequence opt4 from capsid_protein__Norovirus__ACH42097

SEQ ID NO: 23706 - RNA, 1623 nt, Artificial Sequence; identical to SEQ ID NO: 22537
  derived and/or modified sequence opt4 from capsid_protein__Norovirus__ACH42098

SEQ ID NO: 23707 - RNA, 1623 nt, Artificial Sequence
  derived and/or modified sequence opt4 from capsid_protein__Norovirus__ACJ66263
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagagacuguacaccggccccagcagcgccuucguggugcagccccagaacggcagaugcaccaccgacggcgugcugcugggcaccacccagcugagcgccgugaacaucugcaccuucagaggcgacgugacccacaucgccggcagcagaaacuacaccaugaaccuggccagccagaacuggaacaacuacgaccccaccgaggagauccccgccccccugggcacccccgacuucgugggcaagauccagggcaugcugacccagaccaccagaagcgacggcagcaccagaggccacaaggccaccgugcugaccggcagcgccgacuucgcccccaagcugggcagagugcaguucgccaccgacaccgacaacgacuucgagagcggccagaacaccaaguucacccccgugggcgugauccaggacggcagcaccacccacagaaacgagccccagcagugggugcugcccaacuacagcggcagaaccggccacaacgugcaccuggcccccgccguggcccccaccuaccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagagcccuguga

SEQ ID NO: 23708 - RNA, 1623 nt, Artificial Sequence
  derived and/or modified sequence opt4 from capsid_protein__Norovirus__ACJ66265
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccaugagcccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagagacuguucaccggccccagcagcgccuucguggugcagccccagaacggcagaugcaccaccgacggcgugcugcugggcaccacccagcugagccccgugaacaucugcaccuucagaggcgacgugacccacaucgccggcacccaggaguacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcgugcacuucacccccaagcugggcagaauccaguucagcaccgacaccagcaacgacuucgagaccggccagaacaccagauucacccccgugggcguggugcaggacggcggcaccacccaccagaacgagccccagcagugggugcugcccaacuacagcggcagagacggccacaacgugcaccuggcccccgccguggcccccagcuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23709 - RNA, 1623 nt, Artificial Sequence
  derived and/or modified sequence opt4 from capsid_protein__Norovirus__ACJ66267
augaagauggccagcaacgacgccaaccccagcgacggcagcaccgccaaccuggugcccgaggugaacagcgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagagacuguacaccggccccagcagcgccuucguggugcagccccagaacggcagaugcaccaccgacggcgugcugcugggcaccacccagcugagcgccgugaacaucugcaccuucagaggcgacgugacccacaucgccggcagcagaaacuacaccaugaaccuggccagccagaacuggaacaacuacgaccccaccgaggagauccccgccccccugggcacccccgacuucgugggcaagauccagggcaugcugacccagaccaccagaagcgacggcagcaccagaggccacaaggccaccgugcugaccggcagcgccgacuucgcccccaagcugggcagagugcaguucgccaccgacaccgacaacgacuucgagagcggccagaacaccaaguucacccccgugggcgugauccaggacggcagcaccacccacagaaacgagccccagcagugggugcugcccagcuacagcggcagaaccggccacaacgugcaccuggcccccgccguggcccccaccuaccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagagcccuguga

SEQ ID NO: 23710 - RNA, 1623 nt, Artificial Sequence
  derived and/or modified sequence opt4 from capsid_protein__Norovirus__ACJ66269
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagagacuguucaccggccccagcagcgccuucguggugcagccccagaacggcagaugcaccaccgacggcgugcugcugggcaccacccagcugagccccgccaacaucugcaccuucagaggcgacgugacccacaucgccggcacccaggaguacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcgugcacuucacccccaagcugggcagaauccaguucagcaccgacaccagcaacgacuucgagaccggccagaacaccagauucacccccgugggcguggugcaggacggcggcaccacccaccagaacgagccccagcagugggugcugcccaacuacagcggcagagacggccacaacgugcaccuggcccccgccguggcccccagcuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23711 - RNA, 1623 nt, Artificial Sequence
  derived and/or modified sequence opt4 from capsid_protein__Norovirus__ACJ66271
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagagacuguucaccggccccagcagcgccuucguggugcagccccagaacggcagaugcaccaccgacggcgugcugcugggcaccacccagcugagcagcgugaacaucugcaccuucagaggcgacgugacccacaucgccggcacccaggaguacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcgugcacuucacccccaagcugggcagaauccaguucagcaccgacaccagcaacgacuucgagaccggccagaacaccagauucacccccgugggcguggugcaggacggcagcaccacccaccagaacgagccccagcagugggugcugcccaacuacagcggcagagacggccacaacgugcaccuggcccccgccguggcccccagcuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23712 - RNA, 1623 nt, Artificial Sequence
  derived and/or modified sequence opt4 from capsid_protein__Norovirus__ACJ66273
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacagcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccaggaguacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcgugcacuucacccccaagcugggcagaauccaguucagcaccgacaccagcaacgacuucgagaccggccagaacaccagauucacccccgugggcguggugcaggacggcagcaccacccaccagaacgagccccagcagugggugcugcccagcuacagcggcagagacagccacaacgugcaccuggcccccgccguggcccccagcuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagagcccuguga

SEQ ID NO: 23713 - RNA, 1623 nt, Artificial Sequence
  derived and/or modified sequence opt4 from capsid_protein__Norovirus__ACJ66275
augaagauggccagcagcgacgccagccccagcgacggcagcgccgccaaccuggugcccgaggugaacaacgaggugauggcccuggagcccguggugggcgccgccaucgccgcccccguggccggccagcagaacaucaucgaccccuggaucagaaacaacuucgugcaggcccccggcggcgaguucaccgugagccccagaaacgcccccggcgagauccuguggagcgccccccugggccccgaccugaaccccuaccugagccaccugagcagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagaccaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagagacuguacaccggccccagcagcgccuucguggugcagccccagaacggcagaugcaccaccgacggcgugcugcugggcaccacccagcugagcgccgugaacaucugcaccuucagaggcgacgugacccacaucgccggcagcagaaacuacaccaugaaccuggccagccagaacuggaacaacuacgaccccaccgaggagauccccgccccccugggcacccccgacuucgugggcaagauccagggcaugcugacccagaccaccagaggcgacggcagcaccagaggccacaaggccaccguguacaccggcagcgccgacuucgcccccaagcugggcagagugcaguucgccaccgacaccgacaacgacuucgagagcaaccagaacaccaaguucacccccgugggcgugauccaggacggcaacaccacccacagaaacgagccccagcagugggugcugcccggcuacagcggcagagacggccacaacgugcaccuggcccccgccguggcccccaccuaccccggcgagcagcugcuguucuucagaagcaccaugcccggcugcagcggcuaccccaacauggaccuggacugccugcugccccaggagugggugcagcacuucuaccaggaggccgcccccgcccagagcgagguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagagcccuguga

SEQ ID NO: 23714 - RNA, 1623 nt, Artificial Sequence
  derived and/or modified sequence opt4 from capsid_protein__Norovirus__ACJ66279
augaagauggccagcaacgacgccacccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccagaacuacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcgugcacuucacccccaagcugggcagcgugcaguucagcaccgacaccagcaacgacuucgagaccggccagaacaccagauucacccccgugggcguggugcaggacggcagcaccacccaccagaacgagccccagcagugggugcugcccgacuacagcggcagagacagccacaacgugcaccuggcccccgccguggcccccaacuuccccggcgagcagcugcuguucuucagaagcaccaugcccggcugcagcggcuaccccaacaugaaccuggacugccugcugccccaggagugggugcagcacuucuaccaggagagcgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagagcccuguga

SEQ ID NO: 23715 - RNA, 1623 nt, Artificial Sequence
  derived and/or modified sequence opt4 from capsid_protein__Norovirus__ACJ66281
augaagauggccagcaacgacgccaaccccagcgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggagaagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23716 - RNA, 1623 nt, Artificial Sequence
  derived and/or modified sequence opt4 from capsid_protein__Norovirus__ACJ66283
augaagauggccagcaacgacgccaaccccagcgacggcagcgccgccaaccuggugcuggaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23717 - RNA, 1623 nt, Artificial Sequence
  derived and/or modified sequence opt4 from capsid_protein__Norovirus__ACJ66285
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccagaaucagaaacaacuucgugcaggcccccggcggcgaguucaccgugagccccagaaacgcccccggcgagauccuguggagcgccccccugggccccgaccugaaccccuaccugagccaccuggccagaauguacaacagcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcugggugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccaggaguacaccaugaaccuggccagccagaacuggaacaacuacgaccccaccgaggagauccccgccccccugggcacccccgacuucgugggcaagauccagggcgugcugacccagaccaccagaagcgacggcagcaccagaggccacaaggccaccgugagcaccggcagcgugcacuucacccccaagcugggcagaauccaguucagcaccgacaccagcaacgacuucgagaccggccagaacaccagauucacccccgugggcguggugcaggacggcagcaccacccaccagaacgagccccagcagugggugcugcccaacuacagcggcagagacagccacaacgugcaccuggcccccgccguggcccccagcuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23718 - RNA, 1623 nt, Artificial Sequence; identical to SEQ ID NO: 22522
  derived and/or modified sequence opt4 from capsid_protein__Norovirus__ACJ66286

SEQ ID NO: 23719 - RNA, 1626 nt, Artificial Sequence
  derived and/or modified sequence opt4 from capsid_protein__Norovirus__ACJ72216
augagaaugagcgacggcgccgcccccaaggccaacggcagcgaggccagcggccaggaccuggugcccaccgccguggagcaggccgugcccauccagcccguggccggcgccgcccuggccgcccccgccgccggccagaucaaccagaucgaccccuggaucuuccagaacuucgugcagugcccccugggcgaguucagcaucagccccagaaacacccccggcgagauccuguucgaccuggcccugggccccggccugaaccccuaccuggcccaccugagcgccauguacaccggcugggugggcaacauggaggugcagcuggugcuggccggcaacgccuucaccgccggcaagguggugguggcccuggugccccccuacuuccccaagggcagccugaccaccgcccagaucaccugcuucccccacgugaugugcgacgugagaacccuggagcccauccagcugccccugcuggacgugagaagagugcuguggcacgccacccaggaccaggaggagagcaugagacuggugugcaugcuguacaccccccugagaaccaacagccccggcgacgagagcuucguggugagcggcagacugcugagcaagcccgccgccgacuucaacuucguguaccugaccccccccaucgagagaaccaucuacagaaugguggaccugcccgugcugcagcccagacugugcacccacgccagauggcccgcccccaucuacggccugcugguggaccccagccugcccagcaacccccaguggcagaacggcagagugcacguggacggcacccugcugggcaccacccccaucagcggcagcugggugagcugcuucgccgccgaggccgccuacgaguuccagagcggcaccggcgagguggugaccuucagcaugaucgagcaggacggcagcgccuacgugcccggcgacagagccgccccccugggcuaccccgacuacagcggccagcuggagaucgaggugcagaccgagaccaccaaggccggcgacaagcugaaggugaccaccuucgagaugauccugggccccaccaccaacguggaccaggcccccuaccagggcaaggccuacgccagccugagcaccaccgccagccuggaccugguggacggcagagugagagccgugcccagaagcguguacagcuuccaggacgugcugcccgaguacaacgacggccugcuggugccccuggcccccccccugggccccuaccugcccggcgaggugcugcugagauucagaaccuacaugagacagcuggacaccgccgacgccgccgcccagcccaucgacugcgcccugccccaggaguucaucagcugguucgccagcagcaacuucaccgugcagagcgaggcccugcuggugagauacagaaacacccugaccggccagcugcuguucgaggccaagcuguacagcgagggcuacaucgccgugagcuacagcggcagcggcccccugaccuuccccaccgacggcuucuucgagguggugagcugggugcccagacuguuccagcuggccagcgugggcagccuggccaccggcagaacccugaagcaguga

SEQ ID NO: 23720 - RNA, 1620 nt, Artificial Sequence
  derived and/or modified sequence opt4 from capsid_protein__Norovirus__ACL27297
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgccgacguguucaccgugagcagaagagugcugaccagacccagccccgacuucgacuucaucuucagcgugccccccaccguggagagcagaaccaagcccuucaccgugcccauccugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaccuucagaggcgacgugacccacaucgccggcagccacgacuacaccaugaaccuggccagccagaacuggaacaacuacgaccccaccgaggagauccccgccccccugggcacccccgacuucgugggcaagauccagggcaugcugacccagaccaccagagaggacggcagcaccagagcccacaaggccaccgugagcaccggcagcgugcacuucacccccaagcugggcagcgugcaguacaccaccgacaccaacaacgacuuccagaccggccagaacaccaaguucacccccgugggcgugauccaggacggcaacaaccaccagaacgagccccagcagugggugcugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcgccggcagaagaagagcccuguga

SEQ ID NO: 23721 - RNA, 1623 nt, Artificial Sequence
  derived and/or modified sequence opt4 from capsid_protein__Norovirus__ACL27298
augaagauggccagcaacgacgccagccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcacccacgacuacaccaugaaccuggccagccagaacuggaacaacuacgaccccaccgaggagauccccgccccccugggcacccccgacuucgugggcaagauccagggcgugcugacccagaccaccagaggcgacggcagcaccagaggccacaaggccaccgugagcaccggcagcgugcacuucacccccaagcugggcagcgugcaguucaccaccgacaccaacaacgacuucgagaccggccagaacaccaaguucacccccgugggcguggugcaggacggcaacagcacccaccagaacgagccccagcagugggugcugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagagcccuguga

SEQ ID NO: 23722 - RNA, 1623 nt, Artificial Sequence
  derived and/or modified sequence opt4 from capsid_protein__Norovirus__ACL27299
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaugaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagagacuguacaccggccccagcagcgccuucguggugcagccccagaacggcagaugcaccaccgacggcgugcugcugggcaccacccagcugagcgccgugaacaucugcaccuucagaggcgacgugacccacaucgccggcagcagaaacuacaccaugaaccuggccagccagaacuggagcaacuacgaccccaccgaggagauccccgccccccugggcacccccgacuucgugggcaagauccagggcaugcugacccagaccaccagaagagacggcagcaccagaggccacaaggccaccgugcugaccggcagcgccgacuucgcccccaagcugggcagagugcaguucgccaccgacaccgacaacgacuucgagagcggcgagaacaccaaguucacccccgugggcgugauccaggacggcagcaccacccacagaaacgagccccagcagugggugcugcccaacuacagcggcagaaccggccacaacgugcaccuggcccccgccguggcccccaccuaccccggcgagcagcugcuguucuucagaagcaccaugcccggcugcagcggcuaccccaacauggaccuggacugccugcugccccaggagugggugagacacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagagcccuguga

SEQ ID NO: 23723 - RNA, 1623 nt, Artificial Sequence
  derived and/or modified sequence opt4 from capsid_protein__Norovirus__ACL27300
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagagacuguacaccggccccagcagcgccuucguggugcagccccagaacggcagaugcaccaccgacggcgugcugcugggcaccacccagcugagcgccgugaacaucugcaccuucagaggcgacgugacccacaucgccggcagcagaaacuacaccaugaaccuggccagccagaacuggagcaacuacgaccccaccgaggagauccccgccccccugggcacccccgacuucgugggcaagauccagggcaugcugacccagaccaccagaagagacggcagcaccagaggccacaaggccaccgugcugaccggcagcgccgacuucgcccccaagcugggcagagugcaguucgccaccgacaccgacaacgacuucgagagcggcgagaacaccaaguucacccccgugggcgugauccaggacggcagcaccacccacagaaacgagccccagcagugggugcugcccaacuacagcggcagaaccggccacaacgugcaccuggcccccgccguggcccccaccuaccccggcgagcagcugcuguucuucagaagcaccaugcccggcugcagcggcuaccccaacauggaccuggacugccugcugccccaggagugggugagacacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagagcccuguga

SEQ ID NO: 23724 - RNA, 1623 nt, Artificial Sequence
  derived and/or modified sequence opt4 from capsid_protein__Norovirus__ACL31312
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccaggaguacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcgugcacuucacccccaagcugggcagaauccaguucagcaccgacaccagcaacgacuucgagaccggccagaacaccagauucacccccgugggcguggugcaggacggcagcaccacccaccagaacgagccccagcagugggugcugcccgacuacagcggcagagacagccacaacgugcaccuggcccccgccguggcccccagcuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23725 - RNA, 1623 nt, Artificial Sequence
  derived and/or modified sequence opt4 from capsid_protein__Norovirus__ACL31313
augaagauggccagcaacgacgccacccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccagaacuacaccaugaaccuggccagccagaacuggaacaacuacgaccccaccgaggagauccccgccccccugggcacccccgacuucgugggcaagauccagggcgugcugacccagaccaccagaggcgacggcagcaccagaggccacaaggccaccgugagcaccggcagcgugcacuucacccccaagcugggcagcgugcaguucagcaccgacaccagcaacgacuucgagaccggccagaacaccagauucacccccgugggcguggugcaggacggcagcaccacccaccagaacgagccccagcagugggugcugcccgccuacagcggcagagacaaccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggagagcgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagagcccuguga

SEQ ID NO: 23726 - RNA, 1623 nt, Artificial Sequence
  derived and/or modified sequence opt4 from capsid_protein__Norovirus__ACL31316
augaagauggccagcagcgacgccacccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccagaacuacaccaugaaccuggccagccagaacuggaacaacuacgaccccaccgaggagauccccgccccccugggcacccccgacuucgugggcaagauccagggcaugcccacccagaccaccagaggcgacggcagcaccagaggccacaaggccaccgugagcaccggcagcgugcacuucacccccaagcugggcagcgugcaguucagcaccgacaccagcaacgacuucgagaccggccagaacaccagauucacccccgugggcguggugcaggacggcagcaccacccaccagaacgagccccagcagugggugcugcccaacuacagcggcagagacagccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggagagcgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagagcccuguga

SEQ ID NO: 23727 - RNA, 1623 nt, Artificial Sequence
  derived and/or modified sequence opt4 from capsid_protein__Norovirus__ACL31317
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagagacuguucaccggccccagcagcgccuucguggugcagccccagaacggcagaugcaccaccgacggcgugcugcugggcaccacccagcugagccccgugaacaucugcaccuucagaggcgacgugacccacaucgccggcacccaggaguacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcgugcacuucacccccaagcugggcagaauccaguucagcaccgacaccagcaacgacuucgagaccggccagaacaccagauucacccccgugggcguggugcaggacggcagcaccacccaccagaacgagccccagcagugggugcugcccgacuacagcggcagagacggccacaacgugcaccuggcccccgccguggcccccagcuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23728 - RNA, 1623 nt, Artificial Sequence
  derived and/or modified sequence opt4 from capsid_protein__Norovirus__ACL31319
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugcugcuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagagacuguucaccggccccagcagcgccuucguggugcagccccagaacggcagaugcaccaccgacggcgugcugcugggcaccacccagcugagccccgugaacaucugcaccuucagaggcgacgugacccacaucgccggcacccaggaguacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcgugcacuucacccccaagcugggcagaauccaguucagcaccgacaccagcaacgacuucgagaccggccagaacaccagauucacccccgugggcguggugcaggacggcggcaccacccaccagaacgagccccagcagugggugcugcccgacuacagcggcagagacagccacaacgugcaccuggcccccgccguggcccccagcuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23729 - RNA, 1623 nt, Artificial Sequence
  derived and/or modified sequence opt4 from capsid_protein__Norovirus__ACL31320
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagagacuguucaccggccccagcagcgccuucguggugcagccccagaacggcagaugcaccaccgacggcgugcugcugggcaccacccagcugagccccgugaacaucugcaccuucagaggcgacgugacccacaucgccggcacccaggaguacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcgugaacuucacccccaagcugggcagaauccaguucagcaccgacaccagcaacgacuucgagaccggccagaacaccagauucacccccgugggcguggugcaggacggcagcaccacccaccagaacgagccccagcagugggugcugcccgacuacagcggcagagacagccacaacgugcaccuggcccccgccguggcccccagcuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23730 - RNA, 1623 nt, Artificial Sequence
  derived and/or modified sequence opt4 from capsid_protein__Norovirus__ACL31322
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccaggaguacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcgugcacuucacccccaagcugggcagaauccaguucagcaccgacaccagcaacgacuucgagaccggccagaacaccagauucacccccgugggcguggugcaggacggcagcaccacccaccagaacgagccccagcagugggcccugcccgacuacagcggcagagacagccacaacgugcaccuggcccccgccguggcccccagcuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23731 - RNA, 1623 nt, Artificial Sequence
  derived and/or modified sequence opt4 from capsid_protein__Norovirus__ACL31324
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagagacuguucaccggccccagcagcgccuucguggugcagccccagaacggcagaugcaccaccgacggcgugcugcugggcaccacccagcugagccccgugaacaucugcaccuucagaggcgacgugacccacaucgccggcacccaggaguacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcgugcacuucacccccaagcugggcagaauccaguucagcaccgacaccagcaacgacuucgagaccggccagaacaccagauucacccccgugggcguggugcaggacggcggcaccacccaccagaacgagccccagcagugggugcugcccgacuacagcggcagagacggccacaacgugcaccuggcccccgccguggcccccagcuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23732 - RNA, 1608 nt, Artificial Sequence
  derived and/or modified sequence opt4 from capsid_protein__Norovirus__ACL31325
augaagauggccagcaacgacgccgcccccagcaacgacggcgccgccggccuggugcccgaggugaacaacgagaccauggcccuggagcccguggugggcgccagcaucgccgccccccugaccggccagaacaacgugaucgaccccuggaucagacugaacuucgugcaggcccccaacggcgaguucaccgugagccccagaaacagccccggcgaggugcugcugaaccuggagcugggccccgagcugaaccccuaccuggcccaccugagcagaauguacaacggcuacgccggcggcguggaggugcaggugcugcuggccggcaccgccuucaccgccggcaagcugguguucgccgccgugcccccccacuucccccuggagaacaucagccccggccagaucaccauguucccccacgugaucaucgacgugagaacccuggagcccgugcugcugccccugcccgacgugagaaacaacuucuuccacuacaaccagcagaacgagcccagaaugagacugguggccaugcuguacaccccccugagaagcaacggcagcggcgacgacguguucaccgugagcugcagagugcugaccagacccagccccgacuucgacuucaacuaccuggugccccccaccguggagagcaagaccaagcccuucacccugcccauccugaccaucggcgagcugaccaacagcagauuccccgugcccaucgacgagcuguacaccagccccaacgagagccugguggugcagccccagaacggcagaugcgcccuggacggcgagcugcagggcaccacccagcugcugcccaccgccaucugcagcuucagaggcagaaucaaccagaaggugagcggcgagaaccacguguggaacaugcaggugaccaacaucaacggcacccccuucgaccccaccgaggacgugcccgccccccugggcacccccgacuucagcggcaagcuguucggcgugcugagccagagagaccacgccaacgccugcagaagccacgacgccgugaucgccaccaacagcgccaaguucacccccaagcugggcgccauccagaucggcaccugggagcaggacgacgugcacaucaaccagcccaccaaguucacccccgugggccuguucgagaacgagggcuucaaccaguggacccugcccaacuacagcggcgcccugacccugaacaugggccuggccccccccguggcccccaccuuccccggcgagcagauccuguucuucagaagccacaucccccugaagggcggcguggccgaccccgugaucgacugccugcugccccaggaguggauccagcaccuguaccaggagagcgcccccagccagaccgacguggcccugaucagauucaccaaccccgacaccggcagagugcuguucgaggccaagcugcacagaagcggcuacaucaccguggccaacaccggcagcagacccaucguggugcccgccaacggcuacuucagauucgacagcugggugaaccaguucuacagccuggcccccaugggcaccggcaacggcagaagaagagugcaguga

SEQ ID NO: 23733 - RNA, 1629 nt, Artificial Sequence
  derived and/or modified sequence opt4 from capsid_protein__Norovirus__ACL31326
augaagauggccagcaacgacgccgcccccagcaacgacggcgccgccagccuggugcccgagggcgugaacgagaccaugccccuggagcccguggccggcgccagcaucgccgcccccguggccggccagaccaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccaucccccccaacuuccccguggacaugaucagccccgcccagaucaccaugcugccccaccugaucguggacgugagaacccuggagcccaucaugaucccccugcccgacgugagaaacguguucuaccacuucaacaaccagccccagcccagaaugagacugguggccaugcuguacaccccccugagaagcaacggcagcggcgacgacguguucaccgugagcugcagagugcugaccagacccacccccgacuucgaguucaucuaccuggugccccccagcguggagagcaagaccaagcccuucacccugcccauccugaccaucagcgagcugaccaacagcagauuccccauccccaucgagcagcuguacaccgcccccaacgagaccaacguggugcagugccagaacggcagaugcacccuggacggcgagcugcagggcaccacccagcugcugagcagcgccgugugcagcuacagaggcagaaccguggccaacagcggcgacaacugggaccagaaccugcugcagcugaccuaccccaacggcgccagcuacgaccccaccgacgaggugcccgccccccugggcacccaggacuucagcggcaugcuguacggcgugcugacccaggacaacgugaacgugagcaccggcgaggccaagaacgccaagggcaucuacaucagcaccaccagcggcaaguucacccccaagaucggcagcaucggccugcacagcaucaccgagcacgugcaccccaaccagcagagcagauucacccccgugggcguggccgugaacgagaacacccccuuccagcagugggugcugccccacuacgccggcagccuggcccugaacaccaaccuggcccccgccguggcccccaccuuccccggcgagcagcugcuguucuucagaagcagagugcccugcgugcagggccugcagggccaggacgccuucaucgacugccugcugccccaggagugggugaaccacuucuaccaggaggccgcccccagccaggccgacguggcccugaucagauacgugaaccccgacaccggcagaacccuguucgaggccaagcugcacagaagcggcuucaucaccgugagccacaccggcgccuacccccugguggugccccccaacggccacuucagauucgacagcugggugaaccaguucuacagccuggcccccaugggcaccggcaacggcagaagaagagugcaguga

SEQ ID NO: 23734 - RNA, 1623 nt, Artificial Sequence
  derived and/or modified sequence opt4 from capsid_protein__Norovirus__ACL31340
augaagauggccagcaacgacgccacccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccugagcagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcaacgugaccaacaucgccggcagccagaccuacaccaugaaccuggccagccagaacuggaacaacuacgaccccaccgaggagauccccgccccccugggcacccccgacuucgugggcaagauccagggcgugcugacccagaccaccaagggcgacggcagcaccagaggccacaaggccaccgugagcaccggcagcgcccaguucacccccaagcugggcagcgugcaguucagcaccgacaccagcaccgacuucgagaccggccagaacaccagauucacccccgugggcgugauccaggacggcagcaccacccacaagaacgagccccagcagugggugcugcccagcuacagcggcagagacagccacaacgugcaccuggcccccgccguggcccccaccuuccccggcgagcagauccuguucuucagaagcaccaugcccggcugcagcggcuaccccaacauggaccuggacugccugcugccccaggagugggugcagcacuucuaccaggagagcgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagagcccuguga

SEQ ID NO: 23735 - RNA, 1623 nt, Artificial Sequence
  derived and/or modified sequence opt4 from capsid_protein__Norovirus__ACL31354
augaagauggccagcaacgacgccaaccccagcgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagcugaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagagacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23736 - RNA, 1623 nt, Artificial Sequence
  derived and/or modified sequence opt4 from capsid_protein__Norovirus__ACL31355
augaagauggccagcaacgacgccaaccccagcgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgaggcccaccagaacaccaaguucacccccgugggcgugauccaggacggcggcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23737 - RNA, 1623 nt, Artificial Sequence; identical to SEQ ID NO: 22512
  derived and/or modified sequence opt4 from capsid_protein__Norovirus__ACL31356

SEQ ID NO: 23738 - RNA, 1623 nt, Artificial Sequence
  derived and/or modified sequence opt4 from capsid_protein__Norovirus__ACL31358
augaagauggccagcaacgacgccaaccccagcgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugauccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgaggcccaccagaacaccaaguucacccccgugggcgugauccaggacggcggcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23739 - RNA, 1647 nt, Artificial Sequence
  derived and/or modified sequence opt4 from capsid_protein__Norovirus__ACL31361
augaagauggccagcaacgacgccgcccccagcaacgacggcgccgccggccuggugcccgagaucaacaacgaggccauggcccuggagcccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgccuucaccgccggcaagaucaucuucgccgccaucccccccaacuuccccaucgacaaccugagcgccgcccagaucaccaugugcccccacgugaucguggacgugagacagcuggagcccgugaaccugcccaugcccgacgugagaaacaacuucuuccacuacaaccagggcagcgacagcagacugagacugaucgccaugcuguacaccccccugagagccaacaacagcggcgacgacguguucaccgugagcugcagagugcugaccagacccagccccgacuucagcuucaacuuccuggugccccccaccguggagagcaagaccaagcccuucagccugcccauccugaccaucagcgagaugagcaacagcagauuccccgugcccaucgacagccugcacaccagccccaccgagaacaucguggugcagugccagaacggcagagugacccuggacggcgagcugaugggcaccacccagcugcugcccagccagaucugcgccuucagaggcgugcugaccagaagcaccagcagagccagcgaccaggccgacaccgccacccccagacuguucaacuacuacuggcacauccagcuggacaaccugaacggcacccccuacgaccccgccgaggacauccccggcccccugggcacccccgacuucagaggcaagguguucggcguggccagccagagaaaccccgacagcaccaccagagcccacgaggccaagaucgacaccaccagcggcagauucacccccaagcugggcagccuggagaucagcaccgagagcgacgacuucgaccagaacaagcccaccagauucacccccgugggcaucggcguggaccacgaggccgacuuccagcagugggcccugcccgacuacgccggccaguucacccacaacaugaaccuggcccccgccguggcccccaacuuccccggcgagcagcugcuguucuucagaagccagcugcccagcagcggcggcagaagcaacggcauccuggacugccuggugccccaggagugggugcagcacuucuaccaggagagcgcccccagccagagccagguggcccuggugagauacaucaaccccgacaccggcagagugcuguucgaggccaagcugcacaagcugggcuucaucaccaucgccaagaacggcgacagccccaucaccgugccccccaacggcuacuucagauucgagagcugggugaaccccuucuacacccuggcccccaugggcaccggcaacggcagaagaagaauccaguga

SEQ ID NO: 23740 - RNA, 1623 nt, Artificial Sequence
  derived and/or modified sequence opt4 from capsid_protein__Norovirus__ACL31365
augaagauggccagcaacgacgccaaccccagcgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagccacaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagcaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23741 - RNA, 1623 nt, Artificial Sequence
  derived and/or modified sequence opt4 from capsid_protein__Norovirus__ACL36375
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggaggugcccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23742 - RNA, 1593 nt, Artificial Sequence; identical to SEQ ID NO: 23655
  derived and/or modified sequence opt4 from capsid_protein__Norovirus__ACN32270

SEQ ID NO: 23743 - RNA, 1608 nt, Artificial Sequence
  derived and/or modified sequence opt4 from capsid_protein__Norovirus__ACT52403
augaagauggccagcaacgacgccagccccagcagcgacggcagcgccaaccuggugcccgagaucaacaacgaggugauggcccuggagcccguggccggcgccgccaucgccgcccccguggccggccagcagaacaucaucgaccccuggaucagaaacaacuucgugcaggcccccggcggcgaguucaccgugagccccagaagcgcccccggcgaggugcugcugaaccugccccugagccccgacaucaaccccuaccuggcccaccugagcagaauguacaacggcuacgccggcggcguggagguggagguggugcuggccggcaacgccuucaccgccggcaagaucaucuucgccgccgugccccccaacuucccccccgagaaccugagccccagccagaucaccaugcugccccacaucaucguggacgugagacagcuggagcccgugagaaucccccugcccgacgugagaaacaacuucuaccacuacagcagagagaacgacagcacccugagacugaucgccaugcuguacaccccccugagagccaacaacgccggcgacgacguguucaccgugagcugcagagugcugaccagacccagccccgacuucgacuucaucuuccuggugccccccaccguggagagcaagagcaagcccuucaccauccccauccugaccaucgaggagaugaccaacagcagauuccccgccccccuggagaugaugaccaccggccccagccacgacaucguggugcagccccagaacggcagaugcaccaucgacggcgugcugcugggcaccacccagcugagccccgugaacaucugcagcaugagaggcgugcccaccaagagaaccaacggcaccgacaacugcuucgugcagcuggagaaccccaacggcagcgccuacgaccccaccgaggacauccccgccgugcugggcagccccgacuucgugggcgaguucuacggcaccaucacccagagaagccccaacaacagcaccagagcccaccccuucacccugaacaccggcagccccagauacacccccaagaucggcagcguggacauccacgugaccgacguggaggaccugaacgaccacgagcccgugaagcugacccccgugggccugagcggcagcagcggcagcauccaccaguggcagcugcccaacuacagcggcguggccacccacaacaugcaccuggcccccagcguggccccccuguuccccggcgagcagauccuguucuucagaagcaccgugcccggcugcggcggcuaccccaacaccaacaucgacugccugaucccccaggagugggugcagcacuucuaccaggagggcgcccccgccagaaccgacguggcccugcugagauucaucaaccccgacaccggcagagugcuguucgagugcaagcugcacaagcacggcuucaucaccguggccuacagcggcaaccacgaccuggugaugccccccaacggcuacuucagauucgagagcugggugaaccaguuccacacccuggcccccaugggcaccggcagcggcagaagaagaauccaguga

SEQ ID NO: 23744 - RNA, 1647 nt, Artificial Sequence
  derived and/or modified sequence opt4 from capsid_protein__Norovirus__ACT52405
augaagauggccagcaacgacgccacccccagcaacgacggcgccgccggccuggugcccgagaucaacaacgaggccauggcccuggaccccguggccggcgccgccaucgccgccccccugaccggccagcagaacaucaucgaccccuggaucauggacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgccuucaccgccggcaagaucaucuucgccgccaucccccccaacuuccccaucgacaaccugagcgccgcccagaucaccaugugcccccacgugaucguggacgugagacagcuggagcccgugaaccugcccaugcccgacgugagaaacaacuucuuccacuacaaccagggcagcgacagcagacugagacugaucgccaugcuguacaccccccugagagccaacaacagcggcgacgacguguucaccgugagcugcagagugcugaccagacccagccccgacuucagcuucaacuuccuggugccccccaccguggagagcaagaccaagcccuucacccugcccauccugaccaucagcgagaugagcaacagcagauuccccgugcccaucgacagccugcacaccagccccaccgacaacaucguggugcagugccagaacggcagagugacccuggacggcgagcugaugggcaccacccagcugcugcccagccagaucugcgccuucagaggcgugcugaccagaagcaccagcagagccagcgaccaggccgacaccgccacccccagacuguucaacuacuacuggcacauccagcuggacaaccugaacggcacccccuacgaccccgccgaggacauccccggcccccugggcacccccgacuucagaggcaagguguucggcguggccagccagagaaaccccgacagcaccaccagagcccacgaggccaagguggacaccaccgccggcagauucacccccaagcugggcagccuggagaucagcaccgagagcaacgacuucgaccagaaccagcccaccagauucacccccgugggcaucggcguggaccacgaggccgacuuccagcaguggagccugcccgacuacagcggccaguucacccacaacaugaaccuggugcccgccguggcccccaacuuccccggcgagcagcugcuguucuucagaagccagcugcccagcagcggcggcagaagcaacggcauccuggacugccuggugccccaggagugggugcagcacuucuaccaggagagcgcccccgcccagacccagguggcccuggugagauacgugaaccccgacaccggcagagugcuguucgaggccaagcugcacaagcugggcuucaugaccaucgccaagaacggcgacagccccaucaccgugccccccaacggcuacuucagauucgagagcugggugaaccccuucuacacccuggcccccaugggcaccggcaacggcagaagaagaaaccaguga

SEQ ID NO: 23745 - RNA, 1647 nt, Artificial Sequence
  derived and/or modified sequence opt4 from capsid_protein__Norovirus__ACT52407
augaagauggccagcaacgacgccacccccagcaacgacggcgccgccggccuggugcccgagaucaacaacgaggccauggcccuggaccccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccugagccaccuggccagaauguacaacggcuacgccggcggcuucgaggugcagguggugcuggccggcaacgccuucaccgccggcaagaucaucuucgccgccaucccccccaacuuccccaucgacaaccugagcgccgcccagaucaccaugugcccccacgugaucguggacgugagacagcuggagcccgugaaccugcccaugcccgacgugagaaacaacuucuuccacuacaaccagggcagcgacagcagacugagacugaucgccaugcuguacaccccccugagagccaacaacagcggcgacgacguguucaccgugagcugcagagugcugaccagacccagccccgacuucagcuucaacuuccuggugccccccaccguggagagcaagaccaagcccuucacccugcccauccugaccaucagcgagaugagcaacagcagauuccccgugcccaucgacagccugcacaccagccccaccgagaacaucguggugcagugccagaacggcagagugacccuggacggcgagcugaugggcaccacccagcugcugcccagccagaucugcgccuucagaggcgugcugaccagaagcaccagcagagccagcgaccaggccgacaccgccacccccagacuguucaacuacuacuggcacauccagcuggacaaccugaacggcacccccuacgaccccgccgaggacauccccggcccccugggcacccccgacuucagaggcaagguguucggcguggccagccagagaaaccccgacagcaccaccagagcccacgaggccaagguggacaccaccgccggcagauucacccccaagcugggcagccuggagaucagcaccgagagcgacgacuucgaccagaaccagcccaccagauucacccccgugggcaucggcguggaccacgaggccgacuuccagcaguggagccugcccgacuacagcggccaguucacccacaacaugaaccuggcccccgccguggcccccaacuuccccggcgagcagcugcuguucuucagaagccagcugcccagcagcggcggcagaagcaacggcauccuggacugccuggugccccaggagugggugcagcacuucuaccaggagagcgcccccgcccagacccagguggcccuggugagauacgugaaccccgacaccggcagagugcuguucgaggccaagcugcacaagcugggcuucaugaccaucgccaagaacggcgacagccccaucaccgugccccccaacggcuacuucagauucgagagcugggugaaccccuucuacacccuggcccccaugggcaccggcaacggcagaagaagaaaccaguga

SEQ ID NO: 23746 - RNA, 1608 nt, Artificial Sequence
  derived and/or modified sequence opt4 from capsid_protein__Norovirus__ACT52409
augaagauggccagcaacgacgccgcccccagcaacgacggcgccgccggccuggugcccgaggugaacaacgagaccauggcccuggagcccguggccggcgccagcaucgccgccccccugaccggccagaacaacgugaucgaccccuggaucagaaugaacuucgugcaggcccccaacggcgaguucaccgugagccccagaaacagccccggcgagauccugcugaaccuggagcugggccccgagcugaaccccuuccuggcccaccugagcagaauguacaacggcuacgccggcggcguggaggugcaggugcugcuggccggcaacgccuucaccgccggcaagcugguguucgccgccauccccccccacuuccccaucgagaaccugagccccggccagaucaccauguucccccacgugaucaucgacgugagaacccuggagcccgugcugcugccccugcccgacgugagaaacagcuucuuccacuacaaccaggagcccgagcccagaaugagacugguggccaugcuguacaccccccugagaagcaacggcagcggcgacgacguguucaccgugagcugcagagugcugaccagacccagccccgacuucgacuucaacuaccuggugccccccaccguggagagcaagaccaagcccuucacccugcccauccugaccaucggcgagcugagcaacagcagauuccccgcccccaucgacgagcuguacaccagccccaacgagggccugguggugcagccccagaacggcagaagcacccuggacggcgagcugcugggcaccacccagcuggugcccagcaacaucugcagccugagaggcagaaccaacgcccaccugcccgacaaccagcacagauggaacaugcaggugaccaaccccaacggcacccccuucgaccccaccgaggacgugcccgccccccugggcacccccgacuuccuggccaacaucuacggcgugaccagccagagaaaccccaacaacaccugcagagcccacgacggcauccuggccaccuggagccccaaguucacccccaagcugggcagcguggugcugggcaccugggaggacagagacuucgacaucaaccagcccaccagauucacccccgugggccuguacgacaccgaccacuucaaccagugggcccugcccaacuacagcggcgcccugacccugaacaugaaccuggcccccagcguggccccccuguuccccggcgagcagcugcuguucuucagaagccacaucccccugaagggcggcaccagcaacggcgccaucgacugccugcugccccaggagugggugcagcacuucuaccaggagagcgcccccagcagcaccgacguggcccugaucagauacaccaaccccgacaccggcagagugcuguucgaggccaagcugcacagacagggcuucaucaccgugagcaacagcggcagcagacccaucguggugccccccaacggcuacuucagauucgacagcugggugaaccaguucuacagccuggcccccaugggcaccggcaacggcagaagaagagugcaguga

SEQ ID NO: 23747 - RNA, 1623 nt, Artificial Sequence
  derived and/or modified sequence opt4 from capsid_protein__Norovirus__ACT78459
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccacccagaacuggaacagcuacgaccccaccgaggagauccccgccccccugggcacccccgacuucgugggcaagauccagggcgugcugacccagaccaccagagccgacggcagcaccagaggccacaaggccaccguguacaccggcagcgccgacuucgcccccaagcugggcagagugcaguucgccaccgacaccgaccacgacuucgacgccaaccagaacaccaaguucacccccgugggcgugauccaggacggcgacaccgcccacagaaacgagccccagcagugggugcugcccagcuacagcggcagaaacagccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23748 - RNA, 1641 nt, Artificial Sequence
  derived and/or modified sequence opt4 from capsid_protein__Norovirus__ACU56258
augaugauggccagcaaggacgccccccagagcgccgacggcgccagcggcgccggccagcuggugcccgaggugaacaccgccgacccccugcccauggagcccguggccggccccaccaccgccguggccaccgccggccaggugaacaugaucgaccccuggaucgugaacaacuucgugcagagcccccagggcgaguucaccaucagccccaacaacacccccggcgacauccuguucgaccugcagcugggcccccaccugaaccccuuccugagccaccugagccagauguacaacggcugggugggcaacaugagagugagaauccugcuggccggcaacgccuucagcgccggcaagaucaucgugugcugcgugccccccggcuucaccagcagcagccugaccaucgcccaggccacccuguucccccacgugaucgccgacgugagaacccuggagcccaucgagaugccccuggaggacgugagaaacgugcuguaccacaccaacgacaaccagcccaccaugagacuggugugcaugcuguacaccccccugagaaccggcggcggcagcggcaacagcgacagcuucgugguggccggcagagugcugaccgcccccagcagcgacuucagcuuccuguuccuggugccccccaccaucgagcagaagaccagagccuucaccgugcccaacaucccccugcagacccugagcaacagcagauuccccagccugauccagggcaugauccugagccccgacgccagccagguggugcaguuccagaacggcagaugccugaucgacggccagcugcugggcaccacccccgccaccagcggccagcuguucagagugagaggcaagaucaaccagggcgccagaacccugaaccugaccgagguggacggcaagcccuucauggccuucgacagccccgcccccgugggcuuccccgacuucggcaagugcgacuggcacaugagaaucagcaagacccccaacaacaccagcagcggcgaccccaugagaagcguggacgugcagaccgacgugcagggcuucgugccccaccugggcagcauccaguucgacgagguguucaaccaccccaccggcgacuacaucggcaccaucgaguggaucagccagcccagcaccccccccggcaccgacaucaaccugugggagauccccgacuacggcagcagccugagccaggccgccaaccuggccccccccguguucccccccggcuucggcgaggcccugguguacuucgugagcgccuuccccggccccaacaacagaagcgcccccaacgacgugcccugccugcugccccaggaguacgugacccacuucgugagcgagcaggcccccaccaugggcgacgccgcccugcugcacuacguggaccccgacaccaacagaaaccugggcgaguucaagcuguaccccggcggcuaccugaccugcgugcccaacggcgugggcgccggcccccagcagcugccccugaacggcguguuccuguucgugagcugggugagcagauucuaccagcugaagcccgugggcaccgccagcaccgccagaggcagacugggcgugagaagaaucuga

SEQ ID NO: 23749 - RNA, 1638 nt, Artificial Sequence
  derived and/or modified sequence opt4 from capsid_protein__Norovirus__ACX33982
augaugauggccagcaaggacgcccccaccaacauggacggcaccagcggcgccggccagcuggugcccgaggccaacaccgccgagcccaucagcauggagcccguggccggcgccgccaccgccgccgccaccgccggccaggugaacaugaucgaccccuggaucaugaacaacuacgugcaggccccccagggcgaguucaccaucagccccaacaacacccccggcgacgugcuguucgaccugcagcugggcccccaccugaaccccuuccugagccaccuggcccagauguacaacggcugggugggcaacaugaaggugaaggugcugcuggccggcaacgccuucaccgccggcaagaucaucaucagcugcaucccccccggcuucgccgcccagaacuucagcaucgcccaggccaccauguucccccacgugaucgccgacgugagagugcuggagcccaucgaggugccccuggaggacgugagaaacgugcuguuccacaacaacgacaacacccccaccaugagacuggugugcaugcuguacaccccccugagagccagcggcagcagcagcggcaccgaccccuucgugaucgccggcagagugcugaccugccccagccccgacuucagcuuccuguuccuggugccccccaacguggagcagaagaccaagcccuucagcgugcccaaccugccccugaacacccugagcaacagcagagugcccagccugaucaagagcaugaugaucagcagagaccacggccagauggugcaguuccagaacggcagagugacccuggacggccagcugcagggcaccacccccaccagcgccagccagcugugcaagaucagaggcagcguguuccacgccaacggcggcaacggcuacaaccugaccgagcuggacggcagccccuaccacgccuucgagagccccgcccccaucggcuuccccgaccugggcgagugcgacuggcacauggaggccagccccaucacccaguucgacaccggcgacgugaucaagcagaucaacgugaagcaggagagcgccuucgccccccaccugggcaccgugcaggccgacggccugagcgacgugagcgccaacaccaacaugaucgccaagcugggcugggugagccccgugagcgacggccacagaagcgacguggaccccugggugauccccagauacggcagcacccugaccgaggccgcccagcuggccccccccaucuacccccccggcuucggcgaggccaucguguucuucaugagcgacuuccccaucgcccacggcaccaacggccugagcgugcccugcaccaucccccaggaguucgugacccacuucgugaacgagcaggcccccaccagaggcgaggccgcccugcugcacuaccuggaccccgacacccacagaaaccugggcgaguucaagcuguaccccgacggcuucaugaccugcgugcccaacagcagcggcaccggcccccagacccugcccaucaacggcguguucguguucgugagcugggugagcagauucuaccagcugaagcccgugggcaccgccggccccgccagaagacugggcaucagaagaagcuga

SEQ ID NO: 23750 - RNA, 1638 nt, Artificial Sequence
  derived and/or modified sequence opt4 from capsid_protein__Norovirus__ACX33983
augaugauggccagcaaggacgcccccaccaacauggacggcaccagcggcgccggccagcuggugcccgaggccaacaccgccgagcccaucagcauggagcccguggccggcgccgccaccgccgccgccaccgccggccaggugaacaugaucgaccccuggaucaugaacaacuacgugcaggccccccagggcgaguucaccaucagccccaacaacacccccggcgacgugcuguucgaccugcagcugggcccccaccugaaccccuuccugagccaccuggcccagauguacaacggcugggugggcaacaugaaggugaaggugcugcuggccggcaacgccuucaccgccggcaagaucaucaucagcugcaucccccccggcuucguggcccagaacuucagcaucgcccaggccaccauguucccccacgugaucgccgacgugagagugcuggagcccaucgaggugccccuggaggacgugagaaacgugcuguuccacaacaacgacaacacccccaccaugagacuggugugcaugcuguacaccccccugagagccggcggcagcagcagcggcaccgaccccuucgugaucgccggcagagugcugaccugccccagccccgacuucagcuuccuguuccuggugccccccaacguggagcagaagaccaagcccuucagcgugcccaaccugccccugaacacccugagcaacagcagagugcccagccugaucaagagcaugaugaucagcagagaccacggccagauggugcaguuccagaacggcagagugacccuggacggccagcugcagggcaccacccccaccagcgccagccagcugugcaagaucagaggcagcguguuccacgccaacggcggcaacggcuacaaccugaccgagcuggacggcagccccuaccacgccuucgagagccccgcccccaucggcuuccccgaccugggcgagugcgacuggcacauggaggccagccccaccacccaguucgacaccggcgacgugaucaagcagaucaacgugaagcaggagagcgccuucgccccccaccugggcaccgugcaggccgacggccugagcgacgugagcgccaacaccaacaugaucgccaagcugggcugggugagccccgugagcgacggccacagaagcgacguggaccccugggugauccccagauacggcagcacccugaccgaggccgcccagcuggccccccccaucuacccccccggcuucggcgaggccaucguguucuucaugagcgacuuccccaucgcccacggcaccaacggccugagcgugcccugcaccaucccccaggaguucgugacccacuucgugaacgagcaggcccccaccagaggcgaggccgcccugcugcacuaccuggaccccgacacccacagaaaccugggcgaguucaagcuguaccccgacggcuucaugaccugcgugcccaacagcagcggcaccggcccccagacccugcccaucaacggcguguucguguucgugagcugggugagcagauucuaccagcugaagcccgugggcaccgccggccccgccagaagacugggcaucagaagaagcuga

SEQ ID NO: 23751 - RNA, 1611 nt, Artificial Sequence
  derived and/or modified sequence opt4 from capsid_protein__Norovirus__ACX81341
augaagauggccagcaacgacgccacccccagcgacgacggcgccgccggccuggugcccgagaucaacaacgaggugauggcccuggagcccguggccggcgccagcaucgccgcccccguggugggccagcagaacaucaucgaccccuggaucagaaacaacuucgugcaggcccccgccggcgaguucaccgugagccccagaaacagccccggcgagcugcugcuggaccuggagcugggccccgagcugaaccccuaccuggcccaccuggccagaauguacaacggccacgccggcggcauggaggugcagaucgugcuggccggcaacgccuucaccgccggcaagauccuguucgccgccaucccccccagcuuccccuacgagaaccugagccccgcccagcugaccaugugcccccacgugaucguggacgugagacagcuggagcccgugcugcugcccaugcccgacaucagaaacguguucuaccacuacaaccagaacaacagccccaagcugagacugguggccaugcuguacaccccccugagagccaacaacagcggcgacgacguguucaccgugagcugcagagugcugaccagacccagccccgacuuccaguucaccuuccuggugccccccaccguggagagcaagaccaagaacuucacccugcccgugcugagagugagcgagaugaccaacagcagauuccccguggugcuggaccagauguacaccagcagaaacgagaacaucaucgugcagccccagaacggcagaugcaccaccgacggcgagcugcugggcaccaccauccugcagagcgugagcaucugcaacuucaagggcaccaugcaggccaagcugaacgaggagcccagauaccagcugcagcugaccaaccuggacggcagccccaucgaccccaccgacgacaugcccgccccccugggcacccccgacuuccaggccaugcuguacggcguggccagccagagaagcagcaucgacaacgccaccagagcccacgacgcccagaucgacaccgccggcgacaccuucgcccccaagaucggccaggugagauucaagagcagcagcaacgacuucgaccugcacgaccccaccaaguucacccccaucggcgugaacguggacgaccagcaccccuucagacaguggagccugcccaacuacggcggccaccuggcccugaacaaccaccuggcccccgccgugaccccccuguuccccggcgagcagauccuguucuucagaagcuacauccccagcgccggcggccacaccgacggcgccauggacugccugcugccccaggaguggguggagcacuucuaccaggaggccgcccccagccagagcgacaucgcccuggugagauucaucaaccccgacaccggcagagugcuguucgaggccaagcugcacaagcagggcuuccugaccaucgccgccagcggcgaccaccccaucgugaugcccaccaacggcuacuucagauucgaggccugggugaaccccuucuacacccuggcccccgugggcaccggcagcggcagaagaagaauccaguga

SEQ ID NO: 23752 - RNA, 1611 nt, Artificial Sequence; identical to SEQ ID NO: 23751
  derived and/or modified sequence opt4 from capsid_protein__Norovirus__ACX81343

SEQ ID NO: 23753 - RNA, 1611 nt, Artificial Sequence
  derived and/or modified sequence opt4 from capsid_protein__Norovirus__ACX81345
augaagauggccagcaacgacgccacccccagcgacgacggcgccgccggccuggugcccgagaucaacagcgaggugauggcccuggagcccguggccggcgccagccuggccgcccccguggugggccagcagaacaucaucgaccccuggaucagaaacaacuucgugcaggcccccgccggcgaguucaccgugagccccagaaacagccccggcgagcugcugcuggaccuggagcugggccccgagcugaaccccuaccuggcccaccuggccagaauguacaacggccacgccggcggcauggaggugcagaucgugcuggccggcaacgccuucaccgccggcaagauccuguucgccgccaucccccccagcuuccccuacgagaaccugagccccgcccagcugaccaugagcccccacgugaucguggacgugagacagcugaagcccgugcugcugcccaugcccgacaucaagaacgacuucaaccacuacaaccagaagaacaacaccaagcugagacugguggccaugcuguacaccccccugagagccaacaacagcggcgacgacgugugcaccgagagcugcagagugcugaccagacccagccccgacuuccaguucaccuuccuggugccccccaccguggagagcaagaccaagaacuucacccugcccgugcugagagugagcgagaugaccaacagcagauuccccguggugcuggaccagauguacaccagcagaaacgagaacaucaucgugcagccccagaacggcagaugcaccaccgacggcgagcugcugggcaccaccauccugcagagcgugagcaucugcaacuucaagggcaccaugcaggccaagcugaacgaggagcccagauaccagcugcagcugaccaaccuggacggcagccccaucgaccccaccgacgacaugcccgccccccugggcacccccgacuuccaggccaugcuguacggcguggccagccagagaagcagcaucgacaacgccaccagagcccacgacgcccagaucgacaccgccggcgacaccuucgcccccaagaucggccaggugagauucaagagcagcagcaacgacuucgaccugcacgaccccaccaaguucacccccaucggcgugaacguggacgaccagcaccccuucagacaguggagccugcccaacuacggcggccaccuggcccugaacaaccaccuggcccccgccgugaccccccuguuccccggcgagcagauccuguucuucagaagcuacauccccagcgccggcggccacaccgacggcgccauggacugccugcugccccaggaguggguggagcacuucuaccaggaggccgcccccagccagagcgacaucgcccuggugagauucaucaaccccgacaccggcagagugcuguucgaggccaagcugcacaagcagggcuuccugaccaucgccgccagcggcgaccaccccaucgugaugcccaccaacggcuacuucagauucgaggccugggugaaccccuucuacacccuggcccccgugggcaccggcagcggcagaagaagaauccaguga

SEQ ID NO: 23754 - RNA, 1611 nt, Artificial Sequence; identical to SEQ ID NO: 23751
  derived and/or modified sequence opt4 from capsid_protein__Norovirus__ACX81347

SEQ ID NO: 23755 - RNA, 1611 nt, Artificial Sequence; identical to SEQ ID NO: 23751
  derived and/or modified sequence opt4 from capsid_protein__Norovirus__ACX81349

SEQ ID NO: 23756 - RNA, 1611 nt, Artificial Sequence; identical to SEQ ID NO: 23751
  derived and/or modified sequence opt4 from capsid_protein__Norovirus__ACX81351

SEQ ID NO: 23757 - RNA, 1611 nt, Artificial Sequence
  derived and/or modified sequence opt4 from capsid_protein__Norovirus__ACX81353
augaagauggccagcaacgacgccacccccagcgacgacggcgccgccggccuggugcccgagaucaacaacgaggugauggcccuggagcccguggccggcgccagcaucgccgcccccguggugggccagcagaacaucaucgaccccuggaucagaaacaacuucgugcaggcccccgccggcgaguucaccgugagccccagaaacagccccggcgagcugcugcuggaccuggagcugggccccgagcugaaccccuaccuggcccaccuggccagaauguacaacggccacgccggcggcauggaggugcagaucgugcuggccggcaacgccuucaccgccggcaagauccuguucgccgccaucccccccagcuuccccuacgagaaccugagccccgcccagcugaccaugugcccccacgugaucguggacgugagacagcuggagcccgugcugcugcccaugcccgacaucagaaacguguucuaccacuacaaccagaacaacagccccaagcugagacugguggccaugcuguacaccccccugagagccaacaacagcggcgacgacguguucaccgugagcugcagagugcugaccagacccagccccgacuuccaguucaccuuccuggugccccccaccguggagagcaagaccaagaacuucacccugcccgugcugagagugagcgagaugaccaacagcagauuccccguggugcuggaccagauguacaccagcagaaacgagaacaucaucgugcagccccagaacggcagaugcaccaccgacggcgagcugcugggcaccaccauccugcagagcgugagcaucugcaacuucaagggcaccaugcaggccaagcugaacgaggagcccagauaccagcugcagcugaccaaccuggacggcagccccaucgaccccaccgacgacaugcccgccccccugggcacccccgacuuccaggccaugcuguacggcguggccagccagagaagcagcagagacaacgccaccagagcccacgacgcccagaucgacaccgccggcgacaccuucgcccccaagaucggccaggugagauucaagagcagcagcaacgacuucgaccugcacgaccccaccaaguucacccccaucggcgugaacguggacgaccagcaccccuucagacaguggagccugcccaacuacggcggccaccuggcccugaacaaccaccuggcccccgccgugaccccccuguuccccggcgagcagauccuguucuucagaagcuacauccccagcgccggcggccacaccgacggcgccauggacugccugcugccccaggaguggguggagcacuucuaccaggaggccgcccccagccagagcgacaucgcccuggugagauucaucaaccccgacaccggcagagugcuguucgaggccaagcugcacaagcagggcuuccugaccaucgccgccagcggcgaccaccccaucgugaugcccaccaacggcuacuucagauucgaggccugggugaaccccuucuacacccuggcccccgugggcaccggcagcggcagaagaagaauccaguga

SEQ ID NO: 23758 - RNA, 1611 nt, Artificial Sequence; identical to SEQ ID NO: 23751
  derived and/or modified sequence opt4 from capsid_protein__Norovirus__ACX81355

SEQ ID NO: 23759 - RNA, 1623 nt, Artificial Sequence
  derived and/or modified sequence opt4 from capsid_protein__Norovirus__ACX85806
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacagcuacgccggcggcuucgaggugcaggugauccuggccggcaacgccuucaccgccggcaagaucaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcaacgugacccacaucgccggcacccaggaguacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcgugcacuucacccccaagcugggcagaauccaguucagcaccgacaccagcaacgacuucgagaccggccagaacaccagauucacccccgugggcguggugcaggacggcagcaccacccaccagaacgagccccagcagugggugcugcccaacuacagcggcagagacagccacaacgugcaccuggcccccgccguggcccccagcuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23760 - RNA, 1647 nt, Artificial Sequence
  derived and/or modified sequence opt4 from capsid_protein__Norovirus__ACX85807
augaagauggccagcaacgacgccgcccccagcaacgacggcgccgccggccuggugcccgagaucaacagcgaggccauggcccuggagcccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgcccugaccgccggcaagaucaucuucgccgccaucccccccaacuuccccaucgacaaccugagcgccgcccagaucaccaugugcccccacgugaucguggacgugagacagcuggagcccgugaaccugcccaugcccgacgugagaaacaacuucuuccacuacaaccagggcagcgacagcagacugagacugaucgccaugcuguacaccccccugagagccaacaacagcggcgacgacguguucaccgugagcugcagagugcugaccagacccagccccgacuucagcuucaacuuccuggugccccccaccguggagagcaagaccaagcccuucagccugcccauccugaccaucagcgagaugagcaacagcagauuccccgugcccaucgacagccugcacaccagccccaccgagaacaucguggugcagugccagaacggcagagugacccuggacggcgagcugaugggcaccacccagcugcugcccagccagaucugcgccuucagaggcgugcugaccagaagcaccagcagagccagcgaccaggccgacaccgccacccccagacuguucaacuacuacuggcacauccagcuggacaaccugaacggcacccccuacgaccccgccgaggacauccccggcccccugggcacccccgacuucagaggcaagguguucggcguggccagccagagaaaccccgacgccaccaccagagcccacgaggccaagaucgacaccaccagcggcagauucacccccaagcugggcagccuggagaucagcaccgagagcgacgacuucgaccagaacaagcccaccagauucacccccgugggcaucggcguggaccacgaggaggacuuccagcaguggacccugcccgacuacgccggccaguucacccacaacaugaaccuggcccccgccguggcccccaacuuccccggcgagcagcugcuguucuucagaagccagcugcccagcagcggcggcagaagcaacggcauccuggacugccuggugccccaggagugggugcagcacuucuaccaggagagcgcccccagccagacccagguggcccuggugagauacaucaaccccgacaccggcagagugcuguucgaggccaagcugcacaagcugggcuucaugaccaucgccaagaacggcgacagccccaucaccgugccccccaacggcuacuucagauucgagagcugggugaaccccuucuacacccuggcccccaugggcaccggcaacggcagaagaagaauccaguga

SEQ ID NO: 23761 - RNA, 1623 nt, Artificial Sequence
  derived and/or modified sequence opt4 from capsid_protein__Norovirus__ACX85809
augaagauggccagcaacgacgccgcccccagcaacgacggcgccgccggccuggugcccgagaucaacaacgaggugaugccccuggagcccguggccggcgccagccuggccacccccguggugggccagcagaacaucaucgaccccuggaucagaaacaacuucgugcaggcccccgccggcgaguucaccgugagccccagaaacagccccggcgagauccugcuggaccuggagcugggccccgagcugaaccccuaccuggcccaccuggccagaauguacaacggccacgccggcggcauggaggugcagaucgugcuggccggcaacgccuucaccgccggcaagaucaucuucgccgccaucccccccggcuuccccuacgagaaccugagccccagccagaucaccaugugcccccacgugaucaucgacgugagacagcuggagcccgugcugcugcccaugcccgacaucagaaacaacuucuuccacuacaaccagggcaacgaccccaagcugagacugaucgccaugcuguacaccccccugagagccaacaacagcggcgacgacguguucaccgugagcuggagaggccugaccaagaccagccccgacuucgaguucaccuuccuggugccccccaccguggagagcaagaccaagcaguucacccugcccauccugaagaucagcgagaugaccaacagcagauuccccgugcccguggagaugauguacaccgccagaaacgagaaccagguggugcagccccagaacggcagagugacccuggacggcgagcugcugggcaccaccccccugcuggccgugaacaucugcaaguucaagggcgaggugaucgccaagaacggcgacgugagaagcuacagaauggacauggagaucaccaacaccgacggcacccccaucgaccccaccgaggacacccccggccccaucggcagccccgacuuccagggcauccuguucggcguggccagccagagaaacaagaacgagcagaaccccgccaccagagcccacgaggccaacaucaacaccggcggcgaccaguacgcccccaagcuggcccaggugaaguucuucagcgagagccaggacuucgaggugcaccagcccaccguguucacccccgugggcguggccggcgacaccagccaccccuucagacagugggugcugcccagauacggcggccaccugaccaacaacacccaccuggcccccgccguggccccccuguuccccggcgagcagauccuguucuucagaagccagauccccagcagcggcggccacgagcugggcuacauggacugccuggugccccaggagugggugcagcacuucuaccaggaggccgccaccgcccagagcgagguggcccugaucagauucaucaaccccgacaccggcagagugcuguucgaggccaagcugcacaagcagggcuucaucaccguggcccacaccggcgacaaccccaucgugaugccccccaacggcuacuucagauucgaggccugggugaaccaguucuacagccuggcccccgugggcaccggcaacggcagaagaagaauccaguga

SEQ ID NO: 23762 - RNA, 1623 nt, Artificial Sequence
  derived and/or modified sequence opt4 from capsid_protein__Norovirus__ACX85810
augaagauggccagcaacgacgccgcccccagcaacgacggcgccgccggccuggugcccgagaucaacaacgaggugaugccccuggagcccguggccggcgccagccuggccacccccguggugggccagcagaacaucaucgaccccuggaucagaaacaacuucgugcaggcccccgccggcgaguucaccgugagccccagaaacagccccggcgagauccugcuggaccuggagcugggccccgagcugaaccccuaccuggcccaccuggccagaauguacaacggccacgccggcggcauggaggugcagaucgugcuggccggcaacgccuucaccgccggcaagaucaucuucgccgccaucccccccggcuuccccuacgagaaccugagccccagccagaucaccaugugcccccacgugaucaucgacgugagacagcuggagcccgugcugcugcccaugcccgacaucagaaacaacuucuuccacuacaaccagggcaacgaccccaagcugagacugaucgccaugcuguacaccccccugagagccaacaacagcggcgacgacguguucaccgugagcugcagagugcugaccaagcccagccccgacuucgaguucaccuuccuggugccccccaccguggagagcaagaccaagcaguucacccugcccauccugaagaucagcgagaugaccaacagcagauuccccgugcccguggagaugauguacaccgccagaaacgagaaccagguggugcagccccagaacggcagagugacccuggacggcgagcugcugggcaccaccccccugcuggccgugaacaucugcaaguucaagggcgaggugaucgccaagaacggcgacgugagaagcuacagaauggacauggagaucaccaacaccgacggcacccccaucgaccccaccgaggacacccccggccccaucggcagccccgacuuccagggcauccuguucggcguggccagccagagaaacaagaacgagcagaaccccgccaccagagcccacgaggccaacaucaacaccggcggcgaccaguacgcccccaagcuggcccaggugaaguucuucagcgagagccaggacuucgaggugcaccagcccaccguguucacccccgugggcguggccggcgacaccagccaccccuucagacagugggugcugcccagauacggcggccaccugaccaacaacacccaccuggcccccgccguggccccccuguuccccggcgagcagauccuguucuucagaagccagauccccagcagcggcggccacgagcugggcuacauggacugccuggugccccaggagugggugcagcacuucuaccaggaggccgccgccgcccagagcgagguggcccugaucagauucaucaaccccgacaccggcagagugcuguucgaggccaagcugcacaagcagggcuucaucaccguggcccacaccggcgacaaccccaucgugaugccccccaacggcuacuucagauucgaggccugggugaaccaguucuacagccuggcccccgugggcaccggcaacggcagaagaagaauccaguga

SEQ ID NO: 23763 - RNA, 1569 nt, Artificial Sequence
  derived and/or modified sequence opt4 from capsid_protein__Norovirus__ACY41155
augaagaugaccgacagagacaccaccgaccccgcccccgcccugggccaggugcugccccccgagguggaggccagcgugcccguggagcccaccgccggcgcccccguggccgccgccaccgccggccaggugaaccccaucgaccccuggaucuucgccaacuucgugcaggccccccagggcgaguucaccaucagccccaacaacaaccccggcgagauccuguucgagcuggagcugggccccgagcugaaccccuaccuggcccaccugagaagaauguacaacggcuggaccggcagcaugagagugagagugcugcuggccggcaacgccuucagcgccggcaagguggugguguucugcgugccccccggcuucgacgccagcuaccugacccccagccaggccacccaguucccccacgugcugaucgacgugagagcccccgagcccguggagaugccccuggaggacgugagaaacauccuguuccaccagggccccgacagcagaaugagacugaugggcaugcuguacaccccccugagagccaacagcggcgccgaccccuucguggugaccggcagagugcugaccugccccagccccaacuucagcuucuucuuccuggugccccccaccguggaggagagagaggugcccuucacccugcccaaccugcccgugaacaaccugagccacagcagagugauggagcccaucgcccagaugaugagcagcagaaaccugcccgccagcgugcaguuccagaacggcagaugcacccuggccggcgaccugcugggcaccacccccagcagccccgccgaccugggcaccuucgugggccugaucgccgagcccggcagcagagugguggagcuguuccagcccaaccaggaggacuuccacgccggcagcgcccccgccccccugggcuuccccgacuucagcgacugcagccugaccuucgugguggccagcagcaccaccgugggcgagagaaccgugaacagcagaagcccccagaacuucacccccgcccugggccacgugacccuggacgaggaggcccccgccgaccuguucagagccagacugagaaaccugugggaccccaccgagcacagcuucuggagaauccccgacuacagagccgacgugcugggcagcgaguucgcccccagcgugagcgcccccggcgugggcgagacccugcuguucuucaugugcaacgugcccagacugaacggcgccaaccccaaccccugccccugccugcugccccaggaguggaucacccacuucgugagcgagagagccgcccugcagggcgacguggcccugcugaacuacgugaaccccaacaccggcagagugcuguucgagugcaagcuguacgccaacggcuuccugaccgugaaccugggcgccagcgaccaggccacccugcccguggacggcaucuucaaguucgugagcugggugagcuucuacuaccagcugagacccgugggcaacgccagcgugggcagaagacugcccagacugaacggcuucuga

SEQ ID NO: 23764 - RNA, 1623 nt, Artificial Sequence; identical to SEQ ID NO: 23098
  derived and/or modified sequence opt4 from capsid_protein__Norovirus__ADA77528

SEQ ID NO: 23765 - RNA, 1620 nt, Artificial Sequence
  derived and/or modified sequence opt4 from capsid_protein__Norovirus__ADB22512
augaagauggccagcaacgacgccgcccccagcaacgacggcgccaccggccuggugcccgaggugaacaccgagacccugccccuggagcccguggccggcgccgccaucgccgcccccgugaccggccagaacaacaucaucgaccccuggaucagaagcaacuucgugcaggcccccaacggcgaguucaccgugagccccagaaacagccccggcgagauccugaugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggacaugcugagccccgcccagaucaccaugcugccccaccugaucguggacgugagaacccuggagcccaucaugaucccccugcccgacgugagaaacguguucuaccacuucaacaaccagcccgcccccagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucacccugcccauccugaccaucggcgagcugaccaacagcagauuccccgcccccaucgaccagcuguacaccagccccaacgccgacgugguggugcagccccagaacggcagaugcacccuggacggcgagcugcagggcaccacccagcugcugaccaccgccaucugcagcuacagaggcaugaccagcaaccccaccagcgacuacugggacggccaccugcugcaccuggugcaccccaacggcgccaccuacgaccccaccgaggacgugcccgcccccuucggcacccaggacuucagaggcauccuguacggcaugcugacccagaaccccagaaccagcggcgacgaggccgccaacagccacggcguguacaucagcagcaccagcgagaaguucacccccaagcugggcaccaucggccugcaccaggugcagggcgaccacagccagcagcagcagagcaaguucacccccgugggcaucgccgugaacggcaacacccccuucagacagugggagcugcccaacuacagcggcgcccugacccugaacaccaaccuggcccccgccgugggccccaacuuccccggcgagcagauccuguucuucagaagcaacgugcccagcgugcagggcggccagcccaucgagaucgacugccugaucccccaggagugggugagccacuucuaccaggagagcgcccccagccagagcgacguggcccuggugagauacgugaaccccgacaccggcagaaccaucuucgaggccaagcugcacagacagggcuucaucaccaucgccgccaccggcagcaaccccgugguggugccccccaacggcuacuucagauucgacagcugggugaaccaguucuacgcccuggcccccaugggcaccggcaacggcagaagaagaauccaguga

SEQ ID NO: 23766 - RNA, 1623 nt, Artificial Sequence
  derived and/or modified sequence opt4 from capsid_protein__Norovirus__ADC91993
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcagcgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23767 - RNA, 1623 nt, Artificial Sequence
  derived and/or modified sequence opt4 from capsid_protein__Norovirus__ADC91994
augaagauggccagcaacgacgccacccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccacccagaacuggaacagcuacgaccccaccgaggagauccccgccccccugggcacccccgacuucgugggcaagauccagggcgugcugacccagaccaccagagccgacggcagcaccagaggccacaaggccaccguguacaccggcagcgccgacuucagccccaagcugggcagagugcaguucgccaccgacaccgacaacgacuucgacgccaaccagaacaccaaguucacccccgugggcgugauccaggacggcgacaccgcccacagaaacgagccccagcagugggugcugcccagcuacagcggcagaaacagccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23768 - RNA, 1611 nt, Artificial Sequence; identical to SEQ ID NO: 23751
  derived and/or modified sequence opt4 from capsid_protein__Norovirus__ADE28701

SEQ ID NO: 23769 - RNA, 1644 nt, Artificial Sequence
  derived and/or modified sequence opt4 from capsid_protein__Norovirus__ADE28721
augaagauggccagcaacgacgccgcccccagcaacgacggcgccgccaaccuggugcccgaggccaacaacgaggugauggcccuggagcccguggugggcgccagcaucgccgcccccguggugggccagcagaacaucaucgaccccuggaucagagagaacuucgugcaggccccccagggcgaguucaccgugagccccagaaacagccccggcgagaugcugcugaaccuggagcugggccccgagcugaaccccuaccugagccaccugagcagaauguacaacggcuacgccggcggcaugcaggugcagguggugcuggccggcaacgccuucaccgccggcaagaucaucuucgccgccgugcccccccacuuccccguggagaacaucagcgccgcccagaucaccaugugcccccacgugaucguggacgugagacagcuggagcccgugcugcugccccugcccgacaucagaaacagauucuuccacuacaaccaggagaacacccccagaaugagacugguggccaugcuguacaccccccugagagccaacagcggcgaggacguguucaccgugagcugcagagugcugaccagacccgcccccgacuucgaguucaccuuccuggugccccccaccguggagagcaagaccaagcccuucacccugcccauccugacccugggcgagcugagcaacagcagauuccccgcccccaucgacaugcuguaccccgaccccaacgagggcaucguggugcagccccagaacggcagaugcacccuggacggcacccugcagggcaccacccagcuggugcccacccagaucugcgccuucagaggcacccugaucggccagaccagcagaagcagcgacagcaccgacagcgcccccagaagaagagaccacccccugcacgugcagcugaagaaccuggacggcacccaguacgaccccaccgacgaggugcccgccgugcugggcgccaucgacuucaagggcaccguguucggcguggccagccagagagacgugagcggccagcaggugggcgccaccagagcccacgaggugcacaucaacaccaccgaccccagauacacccccaagcugggcagcauccugaugcacagcgagagcgacgacuucgugaccggccagcccgugagauucacccccaucggcaugggcgacaacgacuggcaccagugggagcugcccgacuacagcggccaccugacccugaacaugagccuggcccccgccguggcccccgccuuccccggcgagagaauccuguucuucagaagcaucgugcccagcgccggcggcuacggcagcggcuacaucgacugccugaucccccaggagugggugcagcacuucuaccaggaggccgcccccagccagagcgccguggcccugaucagauacgugaaccccgacaccggcagaaacaucuucgaggccaagcugcacagagagggcuucaucaccguggccaacagcggcaacaaccccaucguggugccccccaacggcuacuucagauucgaggccugggugaaccaguucuacacccugacccccaugggcaccggccagggcagaagaagaaaccaguga

SEQ ID NO: 23770 - RNA, 1644 nt, Artificial Sequence
  derived and/or modified sequence opt4 from capsid_protein__Norovirus__ADE28722
augaagauggccagcaacgacgccgcccccagcaacgacggcgccgccaaccuggugcccgaggccaacaacgaggugauggcccuggagcccguggugggcgccagcaucgccgcccccguggugggccagcagaacaucaucgaccccuggaucagagagaacuucgugcaggccccccagggcgaguucaccgugagccccagaaacagccccggcgagaugcugcugaaccuggagcugggccccgagcugaaccccuaccugagccaccugagcagaauguacaacggcuacgccggcggcaugcaggugcagguggugcuggccggcaacgccuucaccgccggcaagaucaucuucgccgccgugcccccccacuuccccguggagaacaucagcgccgcccagaucaccaugugcccccacgugaucguggacgugagacagcuggagcccgugcugcugccccugcccgacaucagaaacagauucuuccacuacaaccaggagaacacccccagaaugagacugguggccaugcuguacaccccccugagagccaacagcggcgaggacguguucaccgugagcugcagagugcugaccagacccgcccccgacuucgaguucaccuuccuggugccccccaccguggagagcaagaccaagcccuucacccugcccauccugacccugggcgagcugagcaacagcagauuccccgcccccaucgacauguucuacaccgaccccaacgagggcaucguggugcacccccagaacggcagaugcacccuggacggcacccugcagggcaccacccagcuggugcccacccagaucugcgccuucagaggcacccugaucggccagaccagcagaagcagcgacagcaccgacagcgcccccagaagaagagaccacccccugcacgugcagcugaagaaccuggacggcacccaguacgaccccaccgacgaggugcccgccgugcugggcgccaucgacuucaagggcaccguguucggcguggccagccagagagacgugagcggccagcaggugggcgccaccagagcccacgaggugcacaucaacaccaccgaccccagauacacccccaagcugggcagcauccugaugcacagcgagagcgacgacuucgugaccggccagcccgugagauucacccccaucggcaugggcgacaacgacuggcaccagugggagcugcccgacuacagcggccaccugacccugaacaugaaccuggcccccgccguggcccccgccuuccccggcgagagaauccuguucuucagaagcaucgugcccagcgccggcggcuacggcagcggcuacaucgacugccugaucccccaggagugggugcagcacuucuaccaggaggccgcccccagccagagcgccguggcccugaucagauacgugaaccccgacaccggcagaaacaucuucgaggccaagcugcacagagagggcuucaucaccguggccaacagcggcaacaaccccaucguggugccccccaacggcuacuucagauucgaggccugggugaaccaguucuacacccugacccccaugggcaccggccagggcagaagaagaaaccaguga

SEQ ID NO: 23771 - RNA, 1644 nt, Artificial Sequence
  derived and/or modified sequence opt4 from capsid_protein__Norovirus__ADE28723
augaagauggccagcaacgacgccgcccccagcaacgacggcgccgccaaccuggugcccgaggccaacaacgaggugauggcccuggagcccguggugggcgccagcaucgccgcccccguggugggccagcagaacaucaucgaccccuggaucagagagaacuucgugcaggccccccagggcgaguucaccgugagccccagaaacagccccggcgagaugcugcugaaccuggagcugggccccgagcugaaccccuaccugagccaccugagcagaauguacaacggcuacgccggcggcaugcaggugcagguggugcuggccggcaacgccuucaccgccggcaagaucaucuucgccgccgugcccccccacuuccccguggagaacaucagcgccgcccagaucaccaugugcccccacgugaucguggacgugagacagcuggagcccgugcugcugccccugcccgacaucagaaacagauucuuccacuacaaccaggagaacacccccagaaugagacugguggccaugcuguacaccccccugagagccaacagcggcgaggacguguucaccgugagcugcagagugcugaccagacccgcccccgacuucgaguucaccuuccuggugccccccaccguggagagcaagaccaagcccuucacccugcccauccugacccugggcgagcugagcaacagcagauuccccgcccccaucgacaugcuguacaccgaccccaacgagggcaucguggugcagccccagaacggcagaugcacccuggacggcacccugcagggcaccacccagcuggugcccacccagaucugcgccuucagaggcacccugaucggccagaucagcagaagcagcgacagcaccgacagcgcccccagaagaagagaccacccccugcacgugcagcugaagaaccuggacggcacccaguacgaccccaccgacgaggugcccgccgugcugggcgccaucgacuucaagggcaccguguucggcguggccagccagagagacgugagcggccagcaggugggcgccaccagagcccacgaggugcacaucaacaccaccgaccccagauacacccccaagcugggcagcauccugaugcacagcgagagcgacgacuucgugaccggccagcccgugagauucacccccaucggcaugggcgacaacgacuggcaccagugggagcugcccgacuacagcggccaccugacccugaacaugaaccuggcccccgccguggcccccgccuuccccggcgagagaauccuguucuucagaagcaucgugcccagcgccggcggcuacggcagcggcuacaucgacugccugaucccccaggagugggugcagcacuucuaccaggaggccgcccccagccagagcgccguggcccugaucagauacgugaaccccgacaccggcagaaacaucuucgaggccaagcugcacagagagggcuucaucaccguggccaacagcggcaacaaccccaucguggugccccccaacggcuacuucagauucgaggccugggugaaccaguucuacacccugacccccaugggcaccggccagggcagaagaagaaaccaguga

SEQ ID NO: 23772 - RNA, 1644 nt, Artificial Sequence
  derived and/or modified sequence opt4 from capsid_protein__Norovirus__ADE28724
augaagauggccagcaacgacgccgcccccagcaacgacggcgccgccaaccuggugcccgaggccaacaacgaggugauggcccuggagcccguggugggcgccagcaucgccgcccccguggugggccagcagaacaucaucgaccccuggaucagagagaacuucgugcaggccccccagggcgaguucaccgugagccccagaaacagccccggcgagaugcugcugaaccuggagcugggccccgagcugaaccccuaccugagccaccugagcagaauguacaacggcuacgccggcggcaugcaggugcagguggugcuggccggcaacgccuucaccgccggcaagaucaucuucgccgccgugcccccccacuuccccguggagaacaucagcgccgcccagaucaccaugugcccccacgugaucguggacgugagacagcuggagcccgugcugcugccccugcccgacaucagaaacagauucuuccacuacaaccaggagaacacccccagaaugagacugguggccaugcuguacaccccccugagagccaacagcggcgaggacguguucaccgugagcugcagagugcugaccagacccgcccccgacuucgaguucaccuuccuggugccccccaccguggagagcaagaccaagcccuucacccugcccauccugacccugggcgagcugagcaacagcagauuccccgcccccaucgacaugcuguacaccgaccccaacgagggcaucguggugcagccccagaacggcagaugcacccuggacggcacccugcagggcaccacccagcuggugcccacccagaucugcgccuucagaggcacccugaucggccagaccagcagaagcagcgacagcaccgacagcgcccccagaagaagagaccacccccugcacgugcagcugaagaaccuggacggcacccaguacgaccccaccgacgaggugcccgccgugcugggcgccaucgacuucaagggcaccguguucggcguggccagccagagagacgugagcggccagcaggugggcgccaccagagcccacgaggugcacaucaacaccaccgaccccagauacacccccaagcugggcagcauccugaugcacagcgagagcgacgacuucgugaccggccagcccgugagauucacccccaucggcaugggcgacaacgacuggcaccagugggagcugcccgacuacagcggccaccugacccugaacaugaaccuggcccccgccguggcccccgccuuccccggcgagagaauccuguucuucagaagcaucgugcccagcgccggcggcuacggcagcgacuacaucgacugccugaucccccaggagugggugcagcacuucuaccaggaggccgcccccagccagagcgccguggcccugaucagauacgugaaccccgacaccggcagaaacaucuucgaggccaagcugcacagagagggcuucaucaccguggccaacagcggcaacaaccccaucguggugccccccaacggcuacuucagauucgaggccugggugaaccaguucuacacccuggcccccaugggcaccggccagggcagaagaagaaaccaguga

SEQ ID NO: 23773 - RNA, 1647 nt, Artificial Sequence
  derived and/or modified sequence opt4 from capsid_protein__Norovirus__ADK23787
augaagauggccagcaacgacgccacccccagcaacgacggcgccgccggccuggugcccgagaucagcaacgaggccauggcccuggaccccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgccuucaccgccggcaagaucaucuucgccgccaucccccccaacuuccccaucgacaaccugagcgccgcccagaucaccaugugcccccacgugaucguggacgugagacagcuggagcccgugaaccugcccaugcccgacgugagaaacaacuucuuccacuacaaccagggcagcgacagcagacugagacugguggccaugcuguacaccccccugagagccaacaacagcggcgacgacguguucaccgugagcugcagagugcugaccagacccagccccgacuucagcuucaacuuccuggugccccccaccguggagagcaagaccaagcccuucacccugcccauccugaccaucagcgagaugagcaacagcagauuccccgugcccaucgacagccugcacaccagccccaccgagaacgugguggugcagugccagaacggcagagugacccuggacggcgagcugaugggcaccacccagcugcugcccagccagaucugcgccuucagaggcgugcugaccagaagcaccagcagagccagcgaccaggccgacaccgccacccccagacuguucaacuacuacuggcacauccagcuggacaaccugaacggcacccccuacgaccccgccgaggacauccccggcccccugggcacccccgacuucagaggcaagguguucggcguggccagccagagaaaccccgacagcaccaccagagcccacgaggccaagaucgacaccaccgccggcagauucacccccaagcugggcagccuggagaucagcaccgagagcggcgacuucgaccagaaccagcccaccagauucacccccgugggcaucggcguggaccacgaggccgacuuccagcaguggagccugcccgacuacagcggccaguucacccacaacaugaaccuggcccccgccguggcccccaacuuccccggcgagcagcugcuguucuucagaagccagcugcccagcagcggcggcagaagcaacggcauccuggacugccuggugccccaggagugggugcagcacuucuaccaggagagcgcccccgcccagacccagguggcccuggugagauacgugaaccccgacaccggcagagugcuguucgaggccaagcugcacaagcugggcuucaugaccaucgccaagaacggcgacagccccaucaccgugccccccaacggcuacuucagauucgagagcugggugaaccccuucuacacccuggcccccaugggcaccggcaacggcagaagaagaauccaguga

SEQ ID NO: 23774 - RNA, 1623 nt, Artificial Sequence
  derived and/or modified sequence opt4 from capsid_protein__Norovirus__ADM52743
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccacccagaacuggaacagcuacgaccccaccgaggagauccccgccccccugggcacccccgacuucgugggcaagauccagggcgugcugacccagaccaccagagccgacggcagcaccagaggccacaaggccaccguguacaccggcagcgccgacuucgcccccaagcugggcagagugcaguucgccaccgacaccgacaacgacuucgacgccaaccagaacaccaaguucacccccgugggcgugauccaggacggcaacaccgcccacagaaacgagccccagcagugggugcugcccagcuacagcggcagaaacagccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23775 - RNA, 1623 nt, Artificial Sequence
  derived and/or modified sequence opt4 from capsid_protein__Norovirus__ADR57234
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagcugaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagccacaacuacaccaugaaccuggccagccagaacuggaacagcuacgaccccaccgaggagauccccgccccccugggcacccccgacuucgugggcaagauccagggcgugcugacccagaccaccagagccgacggcagcaccagaggccacagagccaccguguacaccggcagcgccgaguucgcccccaagcugggcagagugcaguucgccaccgacaccgagaacgacuucgacaccaaccagaacaccaaguucacccccgugggcgugauccaggacggcaacaccacccacagaaacgagccccagcagugggugcugcccagcuacagcggcagaaacagccacaacgugcaccuggcccccgccguggcccccaccuuccccggcgagcagcugcuguucuucagaagcaccaugcccggcugcagcggcuaccccaaccuggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23776 - RNA, 1626 nt, Artificial Sequence
  derived and/or modified sequence opt4 from capsid_protein__Norovirus__AEA07712
augagaaugagcgacggcgccgcccccaaggccagcggcagcgaggccagcggccaggaccuggugcccagcgccguggagcaggccgugcccauccagcccguggugggcgccacccuggccgcccccgccgccggccagaucaaccagaucgaccccuggaucuuccagaacuucgugcagugcccccugggcgaguucagcaucagccccagaaacacccccggcgagauccuguucgaccuggcccugggccccggccugaaccccuaccuggcccaccugagcgccauguacaccggcugggugggcaacauggaggugcagcuggugcuggccggcaacgccuucaccgccggcaagguggugguggcccuggugccccccuacuuccccaagggcagcaucaccaccgcccagaucaccugcuucccccacgugaugugcgacgugagaacccuggagcccauccagcugccccugcuggacgugagaagagugcuguggcacgccacccaggaccaggaggagagcaugagacuggugugcaugcuguacaccccccugagaaccaacagccccggcgacgagagcuucguggugagcggcagacugcugagcaagcccgccgccgacuucaacuucguguaccugaccccccccaucgagagaaccaucuacagaaugguggaccugcccgugcugcagcccagacugugcacccacgccagauggcccgcccccguguacggccugcugguggaccccagccugcccagcaacccccaguggcagaacggcagagugcacguggacggcacccugcugggcaccacccccgugagcggcagcugggugagcugcuucgccgccgaggccgccuacgaguuccagagcggcaucggcgagguggccaccuucacccugaucgagcaggacggcagcgccuaccugcccggcgacagagccgccccccugggcuaccccgacuucagcggccagcuggagaucgaggugcagaccgagaccaccaaggccggcgacaagcugaaggugaccaccuucgagauggcccugggccccaccaccaacguggaccaggcccccuaccagggcagaguguucgccagcuucaccgccagcgccagccuggaccugguggacggcagagugagagccgugcccagaagcaucuucggcuuccaggacguggugcccgaguacaacgacggccugcuggugccccuggccccccccaucggccccuuccugcccggcgaggugcugcugagauucagaaccuacaugagacagaucgacagcagcgacgccgccgccgaggccaucgacugcgcccugccccaggaguucgugagcugguucgccagcaacggcuucaccgugcagagcgacgcccugcugcugagauacagaaacacccugaccggccagcugcuguucgagugcaagcuguacagcgacggcuacaucgcccugagcuacagcggcagcggcccccugaccuuccccaccgacggcuucuucgagguggugagcugggugcccagacuguaccagcuggccagcgugggcagccuggccaccggcagaacccugaagcaguga

SEQ ID NO: 23777 - RNA, 1623 nt, Artificial Sequence
  derived and/or modified sequence opt4 from capsid_protein__Norovirus__AEK05311
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucgccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucgcccccgugggcgugauccaggacggcagcaccacccacagaaacgagccccagcagugggugcugcccagcuacagcggcggcaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23778 - RNA, 1608 nt, Artificial Sequence
  derived and/or modified sequence opt4 from capsid_protein__Norovirus__AEP16505
augaagauggccagcagcgacgccgcccccagcaacgacggcgccgccggccuggugcccgaggugaacaacgagaccauggcccuggagcccguggccggcgccagcaucgccgccccccugaccggccagaacaacgugaucgaccccuggaucagaaugaacuucgugcaggcccccaacggcgaguucaccgugagccccagaaacagccccggcgaggugcugcugaaccuggagcugggccccgagcugaaccccuuccuggcccaccugagcagaauguacaacggcuacgccggcggcguggaggugcaggugcugcuggccggcaacgccuucaccgccggcaagcugguguucgccgccauccccccccacuucccccuggagaaccugagccccggccagaucaccauguucccccacgugaucaucgacgugagaacccuggagcccgugcugcugccccugcccgacgugagaaacaacuucuuccacuacaaccagcagcccgagcccagaaugagacugguggccaugcuguacaccccccugagaagcaacggcagcggcgacgacguguucaccgugagcugcagagugcugaccagacccagccccgacuucgacuucaacuaccuggugccccccaccguggagagcaagaccaagcccuucacccugcccauccugaccaucggcgagcugagcaacagcagauuccccgugcccaucgacgagcuguacaccagccccaacgagggcgugguggugcagccccagaacggcagaagcacccuggacggcgagcugcugggcaccacccagcuggugcccagcaacaucugcgcccugagaggcagaaucaacgcccaggugcccgacgaccaccaccaguggaaccugcaggugaccaacgccaacggcaccagcuucgaccccaccgaggacgugcccgccccccugggcacccccgacuuccuggccaacaucuacggcgugaccagccagagaaaccccgacaacaccugcagagcccacgacggcgugcuggccaccuggagccccaaguucacccccaagcugggcagcguggugcugggcaccugggaggagagcgaccuggaccugaaccagcccaccagauucacccccgugggccuguacgacaccaaccacuucgaccaguggauccugcccaacuacagcggcagacugacccugaacaugaaccuggcccccagcguggccccccuguuccccggcgagcagauccuguucuucagaagccacaucccccugaagggcggcaccagcaacggcgccaucgacugccugcugccccaggaguggauccagcacuucuaccaggagagcgcccccagccccaccgacguggcccugaucagauaccccaaccccgacaccggcagagugcuguucgaggccaagcugcugagacccggcuucaucaccguggccaacuucggcuucaagcccaucguggugccccccaagggcuacuucagauucgacagcugggugaaccaguucuacagccuggcccccaugggcaccggcaacggcagaagaagagugcaguga

SEQ ID NO: 23779 - RNA, 1632 nt, Artificial Sequence
  derived and/or modified sequence opt4 from capsid_protein__Norovirus__AEY77318
augaugauggccagcaaggacgcccccaccaacauggacggcaccagcggcgccggccagcuggugcccgaggugagcaccgccgagcccaucagcauggagcccguggccggcgccgccaccgccgccgccaccgccggccaggugaacaugaucgaccccuggaucaugagcaacuacgugcaggccccccagggcgaguucaccaucagccccaacaacacccccggcgacauccuguucgaccugcagcugggcccccaccugaaccccuuccugagccaccuggcccagauguacaacggcugggugggcaacaugaaggugagagugcugcuggccggcaacgccuucaccgccggcaagaucaucaucagcugcgugccccccggcuucgccgcccagaacgugagcaucgcccaggccaccauguucccccacgugaucgccgacgugagagugcuggagcccaucgaggugccccuggaggacgugagaaacgugcuguuccacaacaacgacagcacccccaccaugagacugaucugcaugcuguacaccccccugagagccagcggcagcagcagcggcaccgaccccuucgugaucgccggcagagugcugaccugccccagccccgacuucaacuuccuguuccuggugccccccaacguggagcagaagaccaagcccuucagcgugcccaaccugccccugaacgugcugagcaacagcagagugcccagccugaucaagagcaugauggugagccaggaccacggccagauggugcaguuccagaacggcagagugacccuggacggccagcugcagggcaccacccccaccagcgccagccagcugugcaagaucagaggcaccguguaccacgccaccggcggccagggccugaaccugaccgagaucgacggcacccccuaccacgccuucgagagccccgcccccaucggcuuccccgaccugggcgagugcgacuggcacaucaacgccagccccgccaacgccuucaccgacggcagcaucauccacagaaucgacguggcccaggacagcaccuucgccccccaccugggcaccauccacuacaccaacgccgacuacaacgccaacgugggccugaucugcagccuggaguggcugagcccccccagcggcggcgcccccaaggugaaccccugggccauccccagauacggcagcacccugaccgaggccgcccagcuggccccccccaucuacccccccggcuucggcgaggccaucguguucuucaugagcgacuuccccaucgccaacggcagcgacggccugagcgugcccugcaccaucccccaggaguucgugacccacuucgugaacgagcaggcccccaccagaggcgaggccgcccugcugcacuacguggaccccgacacccacagaaaccugggcgaguucaagcuguaccccgagggcuucaugaccugcgugcccaacagcagcggcagcggcccccagacccugcccaucaacggcguguucaccuucaucagcugggugagcagauucuaccagcugaagcccgugggcaccaccggccccgugagaagacugggcaucagaagaagcuga

SEQ ID NO: 23780 - RNA, 1626 nt, Artificial Sequence
  derived and/or modified sequence opt4 from capsid_protein__Norovirus__AEY83583
augagaaugagcgacggcgccgcccccaaggccaacggcagcgaggccagcggccaggaccuggugcccaccgccguggagcaggccgugcccauccagcccguggccggcgccgcccuggccgcccccgccgccggccagaucaaccagaucgaccccuggaucuuccagaacuucgugcagugcccccugggcgaguucagcaucagccccagaaacacccccggcgagauccuguucgaccuggcccugggccccggccugaaccccuaccuggcccaccugagcgccauguacaccggcugggugggcaacauggaggugcagcuggugcuggccggcaacgccuucaccgccggcaagguggugguggcccuggugccccccuacuuccccaagggcagccugaccaccgcccagaucaccugcuucccccacgugaugugcgacgugagaacccuggagcccauccagcugccccugcuggacgugagaagagugcuguggcacgccacccaggaccaggaggagagcaugagacuggugugcaugcuguacaccccccugagaaccaacagccccggcgacgagagcuucguggugagcggcagacugcugagcaagcccgcccccgacuucaacuucguguaccugaccccccccaucgagagaaccaucuacagaaugguggaccugcccgugcugcagcccagacugugcacccacgccagauggcccgcccccguguacggccugcugguggaccccagccugcccagcaacccccaguggcagaacggcagagugcagguggacggcacccugcugggcaccacccccgugagcggcagcugggugagcugcuucgccgccgaggccgccuacgaguuccaggccggcaccggcgagguggugaccuucaccaugaucgagcaggacggcagcgccuacgugcccggcgacagagccgccccccugggcuaccccgacuucagcggccagcuggagaucgaggugcagaccgagaccaccaagaccggcgacaagcugagagugaccaccuucgagaugauccugggccccaccaccaacguggaccaggcccccuaccagggcagagccuacgccagccugaccgccgccgccagccuggaccugguggacggcagagugagagccgugcccagaagcaucuacagcuuccaggacgagcugcccgaguacaacgacggcgugcuggugccccuggcccccccccugggccccuuccugcccggcgaggugcugcugagauucagaaccuacaugagacagcuggacaccgccgacgccgccgcccagcccaucgacugcgcccugccccaggaguucaucagcugguucgccagcaacaacuucaccgugcagagcgacgcccugcuggugagauacagaaacacccugaccggccagcugcuguucgaggccaagcuguacagcgagggcuacaucgccgugagcuacagcggcagcggcccccugaccuuccccaccgacggcuucuucgagguggugagcugggugcccagacuguuccagcuggccagcgugggcagccuggugaccggcagaacccugaagcaguga

SEQ ID NO: 23781 - RNA, 1629 nt, Artificial Sequence
  derived and/or modified sequence opt4 from capsid_protein__Norovirus__AFB18010
augaagauggccagcaacgacgccgcccccagcaccgacggcgccgccggccuggugcccgagagcaacaacgaggugauggcccuggagcccguggccggcgccgcccuggccgcccccgugaccggccagaccaacaucaucgaccccuggaucagaaccaacuucgugcaggcccccaacggcgaguucaccgugagccccagaaacgcccccggcgaggugcugcugaaccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccguggagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggaguucaagaccaagcccuucacccugcccauccugacccugggcgagaugagcaacagcagauuccccgugcccaucgaccagauguacaccagccccaacgagaucaucagcgugcagugccagaacggcagaugcacccuggacggcgagcugcagggcaccacccagcugcaggugagcggcaucugcgccuucaagggccaggugaccgcccaccugcaggacaacgagcaccuguacaacgugaccaucaccaaccugaacggcagccccuucgaccccagcgaggacauccccgccccccugggcgugcccgacuucgagggcagaguguucggcgugaucagccagagagacaacuacaacagcggcggccagaaccagcccgccaacagaagccacgacgccguggugcccaccuacaccgcccaguacacccccaagcugggccagauccagaucggcaccuggcagaccgacgacaucaccguggaccagcccgccaaguucacccccgugggccugagcgacaccgaccacagcaaccaguggguggugcccagauacgccggcgcccugaaccugaacaccaaccuggcccccagcguggcccccguguuccccggcgagagacugcuguucuucagaagcuacaucccccugaagggcggcuucggcaaccccgccaucgacugccuggugccccaggaguggauccagcacuucuaccaggaggccgcccccagccugagcgagguggcccuggccagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagaauccaguga

SEQ ID NO: 23782 - RNA, 1623 nt, Artificial Sequence
  derived and/or modified sequence opt4 from capsid_protein__Norovirus__AFB18013
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcacccacaacuacaccaugaaccuggccagccagaacuggaacaacuacgaccccaccgaggagauccccgccccccugggcacccccgacuucgugggcagaauccagggcaugcugacccagaccaccagaggcgacggcagcaccagaggccacaaggccaccgugagcaccggcgacgugcacuucacccccaagcugggcagcauccaguucaacaccgacaccaacaacgacuucgagaccggccagaacaccaaguucacccccgugggcguggugcaggacggcaacggcacccaccagaacgagccccagcagugggugcugcccagcuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23783 - RNA, 1743 nt, Artificial Sequence
  derived and/or modified sequence opt4 from capsid_protein__Norovirus__AFJ05624
augaagauggccagcaacgacgccaccgcccccagccaggacggcgccgccaaccuggugcccgagagccagcacgaggugcuggcccuggagcccguggccggcgccgcccuggccgcccccguggccggccaguucaacgccaucgaccccuggaucaagcagaacuucgugcaggcccccgccggcgaguucaccgugagccccagaaacgcccccggcgagauccugauggaccuggagcugggccccgagcugaaccccuuccuggcccaccuggcccagauguacaacgccuacgccggcggcauggaggugcagaucauccuggccggcaacgccuucaccgccggcaagaucaucgugugcgccgugccccccaacuucccccccgacagacugagcgccagccaggccaccaacuucccccacgugaucauggacgugagaacccuggagcccgugauccugccccugcccgacgugagagccggcuucuuccacuacaaccagcugagagagcccagaaugagacugauggcccugcuguacaccccccugagagccaacggcaccggcgacgacgccuucaccgugagcugcagagugcugaccagacccaugcaggacuucgaguucauguuccuggugccccccaccguggagagcagagugacccccuucagcgugcccaccuaccccgugguggagaugaccaacagcagauggcccgccagaaucagcggcaugcacgugaacgccaaccagacccuggccgugcaguuccagaacggcagaugcacccuggacggccagcugaugggcaccacccagcugugcgccgccgacgugugcagaaugagaggcagauacaccagcaccagagccgaccuggccggcguggaccacaccgaccagggccccagccugggcaccggccccagcgacgacagcgugagcgugcccgaggccagagcccagaccagaaccggcgugagcgcccaccugcagcuggaggagcugaacggccagcccuacgagguguacggcgagcagcccgccccccugggcacccccgacuucagaugcagacugaugggcgagcuggugagacugcccagcaccagccccgccgcccagagcagauucagagacgccuucuucgacaccuacggcgcccuguucgcccccgccgugggcagcaccaccuucaccgugaacaacagcagcaccagcgacuucgccaacggccagcccuucgaguuccugcccaucggcguggagaucggcaacagcgcccaguacgacgaguucgcccugcccagcuacaacggcgccaucggcgagaacagacaccuggcccccguggccgcccccggcuuccccggcgagaacaucguguucuucagcagcaaccugcccgugugggacagcaccagcgcccagaacaacagaagaaucagcugccugcugcccaacgaguucgugcagcacuucuacgaccugcaggcccccagccagagcgacguggcccugcugagauacgugcaccccgagagcggcagagugcuguucgagugcaagcuguacagagacggcuuccugaccgugaacggcgccagccuggccgaguuccccgugaacggcuacuucagauucgacagcugggugaaccaguucuucacccugagccccgugggcaccggcagcggcagaagaggcagaagcagaaacgcccaguga

SEQ ID NO: 23784 - RNA, 1746 nt, Artificial Sequence
  derived and/or modified sequence opt4 from capsid_protein__Norovirus__AFJ05628
augaagauggccagcaacgacgccgccagccccagcagcgacggcgccgccaaccuggugcccgagaucaacaacgaggugauggcccuggagcccguggccggcgcccagcuggccgcccccguggccggccaguucaacgccaucgaccccuggaucagacagaacuucgugcaggcccccgagggcgaguucaccgugagccccagaaacgcccccggcgagauccugcugaaccuggagcugggcccccaccugaaccccuuccugcagcaccuggcccagauguacaacgccuacgccggcggcauggaggugcagguggugcuggccggcaacgccuucaccgccggcaagaucaucuucgccgccgugcccccccacuucccccccgagagacugagcgccgcccaggccacccaguucccccacgugaucguggacgugagacagcuggagcccaucauccugccccugcccgacgugagacacaaccuguuccacuucaaccagcagaacgacgagagaaugcaccugguggccuuccuguacaccccccugagagccaacagcggcagcggcgacgacguguucaccgugagcugcagagugcugaccagacccagccaggacuucgaguucauguuccuggugccccccaccguggagaagaagaccguggccuucagccugccccagcuggccaucggcgagaugagcaacagcagauggcccgccagaaucaccggccuggugguggaccccagacugccccaggugcugcacauccagaacggcagaugcacccuggacggcacccugaugggcaccacccagcugaaccccaacgacaucugcagaaucagaggcuacuucagcagcagcagacccgagcugcugugcgagaacgaggagagcgccaccgaccccaugcccaccgagaccgacaccgacaaccagccccccgaggugagagcccaggccagagccacccagagaugguucgccgugaccgagcugaacggccagguguacgaccccuucggcgaccagcccgccccccugggcgugcccgacuucaaggccagaauccugggcgcccugaugagacugcccggcaccaaccccaccagcaacagcagauucgaggacgccuggguggagaccaacaaccagaccaccuacgcccccgccgccggcgugguggccaucaccaccaacgacaacagcagcagcaacuacgccaacgaccagaccugcgaguucgugccccugggcaucgagaucaccgacagcgcccccuaccacgaguucgaccugcccagcuacggcggcgccgccagcagcggcaacagaaaccuggcccccaccguggcccccaccuuccccggcgaggccauccugcuguucggcagcaacaugcccguguacaacagaaacaccggcaccagcaacaaggacaucagaugccugcugcccaacgaguacgugcagcaccuguacgacacccaggcccccagccugagcgacguggcccuggugagauacgugaacagagacaccggcagagugcuguucgaggccaagcugcacagagacggcuucaugaccgugaacgccagcagcaccaccgugcugcccguggacggcuacuucagauucgacagcugggugaaccaguucuacgcccugagccccgugggcaacgccagcggcagaagaggcagaagcagacagaccaacuga

SEQ ID NO: 23785 - RNA, 1623 nt, Artificial Sequence
  derived and/or modified sequence opt4 from capsid_protein__Norovirus__AFJ24945
augaagauggccagcaacgacgccaaccccagcgacggcagcgccgccagccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcggcaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23786 - RNA, 1638 nt, Artificial Sequence
  derived and/or modified sequence opt4 from capsid_protein__Norovirus__AFK75851
augaugauggccagcaaggacgccccccccaacauggacggcaccagcggcgccggccagcuggugcccgaggccaacaccgccgagcccaucagcauggagcccguggccggcgccgccaccgccgccgccaccgccggccaggugaacaugaucgaccccuggaucaugaacaacuacgugcaggccccccagggcgaguucaccaucagccccaacaacacccccggcgacauccuguucgaccugcagcugggcccccaccugaaccccuuccugagccaccuggcccagauguacaacggcugggugggcaacaugaaggugaaggugcugcuggccggcaacgccuucaccgccggcaagaucaucaucagcugcaucccccccggcuucgccgcccagaacaucagcaucgcccaggccaccauguucccccacgugaucgccgacgugagagugcuggagcccaucgaggugccccuggaggacgugagaaacgugcuguuccacaacaacgacaacacccccaccaugagacuggugugcaugcuguacaccccccugagagccagcggcagcagcagcggcaccgaccccuucgugaucgccggcagagugcugaccugccccagccccgacuucagcuuccuguuccuggugccccccaacguggagcagaagaccaagcccuucagcgugcccaaccugccccugaacacccugagcaacagcagagugcccagccugaucagaagcaugauggugagcagagaccacggccagauggugcaguuccagaacggcagagugacccuggacggccagcugcagggcaccacccccaccagcgccagccagcugugcaagaucagaggcagcguguuccacgccaacggcggcaacggcuacaaccugaccgagcuggacggcagccccuaccacgccuucgagagccccgcccccaucggcuuccccgaccugggcgagugcgacuggcacauggaggccagccccaccacccaguucgacaccggcgacgugaucaagcagaucaacgugaagcaggaggccgccuucgccccccaccugggcaccauccaggccgacggccugagcgacgugagcgugaacaccaacaugaucgccaagcugggcugggugagccccgugagcgacggccacagaggcagcguggaccccugggugauccccagauacggcagcacccugaccgaggccgcccagcuggccccccccaucuacccccccggcuucggcgaggccaucguguucuucaugagcgacuuccccaucgcccacggcgccaacggccugagcgugcccugcaccaucccccaggaguucgugacccacuucgugaacgagcaggcccccaccagaggcgaggccgcccugcugcacuaccuggaccccgacacccacagaaaccugggcgaguucaagcuguaccccgagggcuucaugaccugcgugcccaacagcagcggcaccggcccccagacccugcccaucaacggcguguucgccuucgugagcugggugagcagauucuaccagcugaagcccgugggcaccgccggccccgccagaagacugggcaucagaagaagcuga

SEQ ID NO: 23787 - RNA, 1635 nt, Artificial Sequence
  derived and/or modified sequence opt4 from capsid_protein__Norovirus__AFK75852
augaugauggccagcaaggacgccacccccagcgccgacggcgccaccggcgccggccagcuggugcccgaggugaacaccgccgaccccauccccaucgaccccguggccggcagcagcaccgcccuggccaccgccggccaggugaaccugaucgaccccuggaucaucaacaacuucgugcaggccccccagggcgaguucaccaucagccccaacaacacccccggcgacgugcuguucgaccugcagcugggcccccaccugaaccccuuccugagccaccugagccagauguacaacggcugggugggcaacaugagagugagaguggugcuggccggcaacgccuucaccgccggcaaggugaucaucugcugcgugccccccggcuuccagagcagaacccugagcaucgcccaggccacccuguucccccacgugaucgccgacgugagaacccuggaccccguggaggugccccuggaggacgugagaaacgugcuguaccacaacaacgacacccagcccaccaugagacugcugugcaugcuguacaccccccugagaaccggcggcgccagcggcggcaccgacagcuucgugguggccggcagagugcugaccugccccggccccgacuucaacuuccuguuccuggugccccccaccguggagcagaagaccagacccuucaccgugcccaacaucccccugaaguaccugagcaacagcagaauccccaaccccaucgagggcaugagccugagccccgaccagacccagaacgugcaguuccagaacggcagaugcaccaucgacggccagccccugggcaccacccccgugagcgugagccagcugugcaaguucagaggcagaaucaccagcggccagaaggugcugaaccugaccgagcuggacggcagccccuucauggccuucgccgcccccgcccccgccggcuuccccgaccugggcagcugcgacuggcacaucgagaugagcaagauccccaacagcagcacccagagcaaccccaucguggugaacagcgugaagcccaacagccagcaguucgugccccaccugagcagcaucacccuggacgacaacgugagcagcggcggcgacuacaucggcaccauccaguggaccagcccccccagcgacagcggcggcgccaacaccaacuucuggaagauccccgacuacggcagcagccuggccgaggccagccagcuggcccccgccguguacccccccggcuucaacgaggugaucguguacuucauggccagcauccccggccccaaccagagcggcagccccaaccuggugcccugccugcugccccaggaguacaucacccacuucaucagcgagcaggcccccauccagggcgaggccgcccugcugcacuacguggaccccgacaccaacagaaaccugggcgaguucaagcuguaccccggcggcuaccugaccugcgugcccaacagcagcagcaccggcccccagcagcugccccuggacggcguguucguguucgccagcugggugagcagauucuaccagcugaagcccgugggcaccgccggccccgccagaggcagacugggcgugagaagauga

SEQ ID NO: 23788 - RNA, 1641 nt, Artificial Sequence
  derived and/or modified sequence opt4 from capsid_protein__Norovirus__AFK75853
augaugauggccagcaaggacgccagccagagcgccgacggcgccagcggcgccggccagcuggugcccgaggugaacaccgccgacccccugcccauggagcccguggccggccccaccaccgccguggccaccgccggccaggugaacaugaucgaccccuggaucgugaacaacuucgugcagagcccccagggcgaguucaccaucagccccaacaacacccccggcgacauccuguucgaccugcagcugggcccccaccugaaccccuuccugagccaccugagccagauguacaacggcugggugggcaacaugagagugagaauccugcuggccggcaacgccuucagcgccggcaagaucaucgugugcugcgugccccccggcuucaccagcagcagccugaccaucgcccaggccacccuguucccccacgugaucgccgacgugagaacccuggagcccaucgagaugccccuggaggacgugagaaacgugcuguaccacaccaacgacaaccagcccaccaugagacuggugugcaugcuguacaccccccugagaaccggcggcggcagcggcaacagcgacagcuucgugguggccggcagagugcugaccgcccccagcagcgacuucagcuuccuguuccuggugccccccaccaucgagcagaagaccagagccuucaccgugcccaacaucccccugcagacccugagcaacagcagauuccccagccugauccagggcaugauccugagccccgacgccagccagguggugcaguuccagaacggcagaugccugaucgacggccagcugcugggcaccacccccgccaccagcggccagcuguucagagugagaggcaagaucaaccagggcgccagaacccugaaccugaccgagguggacggcaagcccuucauggccuucgacagccccgcccccgugggcuuccccgacuucggcaagugcgacuggcacaugagaaucagcaagacccccaacaacaccagcagcggcgaccccaugagaagcgugagcgugcagaccaacgugcagggcuucgugccccaccugggcagcauccaguucgacgagguguucaaccaccccaccggcgacuacaucggcaccaucgaguggaucagccagcccagcaccccccccggcaccgacaucaaccugugggagauccccgacuacggcagcagccugagccaggccgccaaccuggccccccccguguucccccccggcuucggcgaggcccugguguacuucgugagcgccuuccccggccccaacaacagaagcgcccccaacgacgugcccugccugcugccccaggaguacaucacccacuucgugagcgagcaggcccccaccaugggcgacgccgcccugcugcacuacguggaccccgacaccaacagaaaccugggcgaguucaagcuguaccccggcggcuaccugaccugcgugcccaacggcgugggcgccggcccccagcagcugccccugaacggcguguuccuguucgugagcugggugagcagauucuaccagcugaagcccgugggcaccgccagcaccgccagaggcagacugggcgugagaagaaucuga

SEQ ID NO: 23789 - RNA, 1647 nt, Artificial Sequence
  derived and/or modified sequence opt4 from capsid_protein__Norovirus__AFK75854
augaagauggccagcaacgacgccgcccccagcaacgacggcgccgccggccuggugcccgagaucaacaacgaggccauggcccuggaccccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgccuucaccgccggcaaggugaucuucgccgccaucccccccaacuuccccaucgacaaccugagcgccgcccagaucaccaugugcccccacgugaucguggacgugagacagcuggagcccaucaaccugcccaugcccgacgugagaaacaccuucuuccacuacaaccaggacagcgacagcagacugagacugaucgccaugcuguacaccccccugagagccaacaacagcggcgacgacguguucaccgugagcugcagagugcugaccagacccagccccgacuucagcuucaacuuccuggugccccccaccguggagagcaagaccaagcuguucacccugcccauccugaccaucagcgagaugagcaacagcagauuccccgugcccaucgacagccugcacaccagccccaccgagaacaucguggugcagugccagaacggcagagugacccuggacggcgagcugaugggcaccacccagcugcugcccagccagaucugcgccuucagaggcacccugaccagaagcaccagcagagccagcgaccaggccgacacccccacccccagacuguucaaccacagauggcacauccagcuggacaaccugaacggcacccccuacgaccccgccgaggacauccccgccccccugggcacccccgacuucagaggcaagguguucggcguggccagccagagaaaccccgacagcaccaccagagcccacgaggccaagguggacaccaccagcggcagauucacccccaagcugggcagccuggagaucaccaccgagagcgacgacuucgacaccaaccagagcaccaaguucacccccgugggcaucggcguggacaacgaggccgaguuccagcaguggagccugcccaacuacagcggccaguucacccacaacaugaaccuggcccccgccguggcccccaacuuccccggcgagcagcugcuguucuucagaagccagcugcccagcagcggcggcuggagcaacggcgugcuggacugccuggugccccaggagugggugcagcacuucuaccaggagagcgcccccgcccagacccagguggcccuggugagauacgugaaccccgacaccggcagagugcuguucgaggccaagcugcacaagcugggcuucaugaccaucgccaagaacggcgacagccccaucaccgugccccccaacggcuacuucagauucgagagcugggugaaccccuucuacacccuggcccccaugggcaccggcaacggcagaagaagaauccaguga

SEQ ID NO: 23790 - RNA, 1671 nt, Artificial Sequence
  derived and/or modified sequence opt4 from capsid_protein__Norovirus__AFN61315
augaagauggccagcagcgacgccgcccccagcgccgacggcgccggcaaccuggugcccgagagccagcaggaggugcugccccuggcccccguggccggcgccgcccuggccgcccccguggugggccagaccaacaucaucgaccccuggaucaaggagaacuucgugcaggccccccagggcgaguucaccgugagccccaagaacagccccggcgagauccuggugaaccuggagcugggccccaagcugaaccccuaccuggaccaccugagcagaauguacaacagcuacgccggcggcaucgacgugaugguggugcuggccggcaacgccuucaccgccggcaaggugcugaucgccgccaucccccccaacuuccccguggagggcgugagcgccagccaggccacccaguucccccacgugaucaucgacgugagaacccuggaccccgugagacugccccugcccgacgugagaagcaccuucuuccacuacaccaacgacaccgagcccaagaugagacuggugaucuggcuguacaccccccugagaaccaacggcagcggcgacgacagcuucaccgugagcggcagaauccugaccagacccagccaggacuucgaguucgccuuccugaucccccccaccguggagaccaagaccacccccuucagcgugcccggcuucagcgugcaggagaugagcaacagcagauggcccgccgccaucagcgccaugguggugagaggcaacgagccccagguggugcaguuccagaacggcagagcccaccuggacggcaugcugcugggcaccacccccgugagccccaacuacaucgccagcuacagaggcaucagcaccggcaacagcagaagcgccagcagcgaggccgacgagagagccgugggcagcuucgacguguggaucagacugcaggagcccgacggccagcccuacgacaucuucggcaagcagcccgcccccaucggcacccccgacuucaaggccgugaucgugggcuucgccgccagaccccugaccagcggcagcuacgccaacgaggccuacgugaacaccaccgccagcgacuacgcccccgccaccggcaacaugagauucaccgugagaaacggcggcaccggccacaucagcgccaacaaguacugggaguucagaagcuucggcguggagggcgagagacacaccgacgugcaguaccaggaguacgagcugcccgacuacagcggccagguggccagcaaccacaaccuggccccccccguggcccccagaaugcccggcgagagccugcugcuguuccagagcaacaugcccgugugggacgacggcagaggcgagagcacccccaagaagauccacugccugcugccccaggaguucaucggccacuucuucgacaagcaggcccccagccugggcgacgccgcccugcugagauacgugaaccaggagaccaacagagugcuguucgagugcaagcuguacagagacggcuacaucaccguggccgccgccagcggccugcuggacuucccccuggacggcuucuucagauucgacagcugggugagcagcuucuacauccugagccccgugggcagcggccagggcagaagaggcagagugagauuccaguga

SEQ ID NO: 23791 - RNA, 1623 nt, Artificial Sequence
  derived and/or modified sequence opt4 from capsid_protein__Norovirus__AFQ00511
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagugcuguga

SEQ ID NO: 23792 - RNA, 1623 nt, Artificial Sequence; identical to SEQ ID NO: 22671
  derived and/or modified sequence opt4 from capsid_protein__Norovirus__AFQ00512

SEQ ID NO: 23793 - RNA, 1623 nt, Artificial Sequence
  derived and/or modified sequence opt4 from capsid_protein__Norovirus__AFQ00513
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23794 - RNA, 1623 nt, Artificial Sequence
  derived and/or modified sequence opt4 from capsid_protein__Norovirus__AFQ00516
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaagcaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucggcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23795 - RNA, 1623 nt, Artificial Sequence; identical to SEQ ID NO: 22671
  derived and/or modified sequence opt4 from capsid_protein__Norovirus__AFQ00517

SEQ ID NO: 23796 - RNA, 1623 nt, Artificial Sequence; identical to SEQ ID NO: 23336
  derived and/or modified sequence opt4 from capsid_protein__Norovirus__AFQ00518

SEQ ID NO: 23797 - RNA, 1623 nt, Artificial Sequence
  derived and/or modified sequence opt4 from capsid_protein__Norovirus__AFQ00519
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccagaggcgacggcagcaccagaggccacaaggccaccguguacaccggcagcgcccccuucacccccaagaugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23798 - RNA, 1623 nt, Artificial Sequence
  derived and/or modified sequence opt4 from capsid_protein__Norovirus__AFQ00520
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcaugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagcccggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23799 - RNA, 1623 nt, Artificial Sequence
  derived and/or modified sequence opt4 from capsid_protein__Norovirus__AFQ00521
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagugcuguga

SEQ ID NO: 23800 - RNA, 1623 nt, Artificial Sequence
  derived and/or modified sequence opt4 from capsid_protein__Norovirus__AFQ00522
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagcccggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23801 - RNA, 1623 nt, Artificial Sequence; identical to SEQ ID NO: 23800
  derived and/or modified sequence opt4 from capsid_protein__Norovirus__AFQ00523

SEQ ID NO: 23802 - RNA, 1623 nt, Artificial Sequence; identical to SEQ ID NO: 23336
  derived and/or modified sequence opt4 from capsid_protein__Norovirus__AFQ00524

SEQ ID NO: 23803 - RNA, 1623 nt, Artificial Sequence; identical to SEQ ID NO: 23336
  derived and/or modified sequence opt4 from capsid_protein__Norovirus__AFQ00525

SEQ ID NO: 23804 - RNA, 1623 nt, Artificial Sequence
  derived and/or modified sequence opt4 from capsid_protein__Norovirus__AFQ00526
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagccacaacuacgccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccaucuacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuaccugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23805 - RNA, 1623 nt, Artificial Sequence; identical to SEQ ID NO: 23336
  derived and/or modified sequence opt4 from capsid_protein__Norovirus__AFQ00527

SEQ ID NO: 23806 - RNA, 1623 nt, Artificial Sequence
  derived and/or modified sequence opt4 from capsid_protein__Norovirus__AFQ00528
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagagacgugcccaacgcccaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23807 - RNA, 1644 nt, Artificial Sequence
  derived and/or modified sequence opt4 from capsid_protein__Norovirus__AGC66782
augaagauggccagcaacgacgccgcccccagcaacgacggcgccgccaaccuggugcccgaggccaacaacgaggugauggcccuggagcccguggugggcgccagcaucgccgcccccguggugggccagcagaacaucaucgaccccuggaucagagagaacuucgugcaggccccccagggcgaguucaccgugagccccagaaacagccccggcgagaugcugcugaaccuggagcugggccccgagcugaaccccuaccugagccaccugagcagaauguacaacggcuacgccggcggcaugcaggugcagguggugcuggccggcaacgccuucaccgccggcaagaucaucuucgccgccgugcccccccacuuccccguggagaacaucagcgccgcccagaucaccaugugcccccacgugaucguggacgugagacagcuggagcccgugcugcugccccugcccgacaucagaaacagauucuuccacuacaaccaggaggacacccccagaaugagacugguggccaugcuguacaccccccugagagccaacagcggcgaggacguguucaccgugagcugcagagugcugaccagacccgcccccgacuucgaguucaccuuccuggugccccccaccguggagagcaagaccaagcccuucacccugcccauccugacccugggcgagcugagcaacagcagauuccccgcccccaucgacaugcuguacaccgaccccaacgagaccaucguggugcagccccagaucggcagaugcacccuggacggcagccugcagggcaccacccagcuggugcccacccagaucugcagcuucggcggcacccugaucagccagaccagcagaagcgccgacagcaccgacagcgcccccagagugagaaaccacccccugcacgugcagcugaagaaccuggacggcacccccuacgaccccaccgacgaggugcccgccgugcugggcgccaucgacuucaagggcaccguguucggcguggccagccagagaaacaccaccggcggcagcgugggcgccaccagagcccacgaggugcacaucgacaccaccaaccccagauacacccccaagcugggcagcgcccugauguacagcgagagcgacgacuucgacgacggccagcccaccagauucacccccaucggcaugggcgccgacgacuggcaccagugggagcugcccgaguacagcggccaccugacccugaacaugaaccuggcccccgccguggcccccgccuuccccggcgagagaauccuguucuucagaagcguggugcccagcgccggcggcuacggcagcggccagaucgacugccugaucccccaggagugggugcagcacuucuaccaggaggccgcccccagccagagcgccguggcccugaucagauacgugaaccccgacaccggcagaaacauccuggaggccaagcugcacagagagggcuucaucaccguggccaacagcggcaacaaccccaucguggugccccccaacggcuacuucagauucgaggccugggugaaccaguucuacacccugacccccaugggcaccggccagggcagaagaagagugcaguga

SEQ ID NO: 23808 - RNA, 1623 nt, Artificial Sequence
  derived and/or modified sequence opt4 from capsid_protein__Norovirus__AGC66784
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagcagcgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaccugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccaucuacaccggcagcgcccccuucacccccaagcugggcagcgugcaguucaacaccgacaccgagaacgacuucgagacccaccagaacaccaaguucacccccgugggcgugauccaggacggcggcaccacccacagaaacgagccccagcagugggugcugcccagcuacagcggcagaaacauccccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23809 - RNA, 1647 nt, Artificial Sequence
  derived and/or modified sequence opt4 from capsid_protein__Norovirus__AGC66785
augaagauggccagcaacgacgccacccccagcaacgacggcgccgccggccuggugcccgagaucaacagcgaggccauggcccuggagcccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgccuucaccgccggcaagaucaucuucgccgccaucccccccaacuuccccaucgacaaccugagcgccgcccagaucaccaugugcccccacgugaucguggacgugagacagcuggagcccgugaaccugcccaugcccgacgugagaaacaacuucuuccacuacaaccagggcagcgacagcagacugagacugaucgccaugcuguacaccccccugagagccaacaacagcggcgacgacguguucaccgugagcugcagagugcugaccagacccagccccgacuucagcuucaacuuccuggugccccccaccguggagagcaagaccaagcccuucagccugcccauccugaccaucagcgagaugagcaacagcagauuccccgugcccaucgacagccugcacaccagccccaccgagaacaucguggugcagugccagaacggcagagugacccuggacggcgagcugaugggcaccacccagcugcugcccagccagaucugcgccuucagaggcaugcugaccagaagcaccagcagagccagcgaccaggccgacaccgccacccccagacuguucaacuacuacuggcacauccagcuggacaaccugaacggcacccccuacgaccccgccgaggacauccccggcccccugggcacccccgacuucagaggcaagguguucggcguggccagccagagaaaccccgacgccaccaccagagcccacgaggccaagaucgacaccaccagcggcagauucacccccaagcugggcagccuggagaucagcaccgagagcggcgacuucgaccagaaccagcccaccagauucacccccgugggcaucggcguggacagagaggccgacuuccagcaguggacccugcccgacuacgccggccaguucacccacaacaugaaccuggcccccgccguggcccccaacuuccccggcgagcagcugcuguucuucagaagccagcugcccagcagcggcggcagaagcaacggcauccuggacugccuggugccccaggagugggugcagcacuucuaccaggagagcgcccccagccagacccagguggcccuggugagauacaucaaccccgacaccggcagagugcuguucgaggccaagcugcacaagcugggcuucaugaccaucgccaagagcggcgacagccccaucaccgugccccccaacggcuacuucagauucgagagcugggugaaccccuucuacacccuggcccccaugggcaccggcaacggcagaagaagaauccaguga

SEQ ID NO: 23810 - RNA, 1644 nt, Artificial Sequence
  derived and/or modified sequence opt4 from capsid_protein__Norovirus__AGC66786
augaagauggccagcaacgacgccgcccccagcaacgacggcgccgccaaccuggugcccgaggccgacaacgaggugauggcccuggagcccguggugggcgccagcaucgccgcccccguggugggccagcagaacaucaucgaccccuggaucagagagaacuucgugcaggccccccagggcgaguucaccgugagccccagaaacagccccggcgagaugcugcugaaccuggagcugggccccggccugaaccccuaccugagccaccugagcagaauguacaacggcuacgccggcggcaugcaggugcagguggugcuggccggcaacgccuucaccgccggcaagaucaucuucgccgccgugcccccccacuuccccguggagaacaucagcgccgcccagaucaccaugugcccccacgugaucguggacgugagacagcuggagcccgugcugcugccccugcccgacaucagaaacagauucuuccacuacaaccaggaggacacccccagaaugagacugguggccaugcuguacaccccccugagagccaacagcggcgaggacguguucaccgugagcugcagagugcugaccagacccgcccccgacuucgaguucaccuuccuggugccccccaccguggagagcaagaccaagcccuucacccugcccauccugacccugggcgagcugagcaacagcagauuccccgcccccaucgacaugcuguacaccgaccccaacgagaccaucguggugcagccccagagcggcagaugcacccuggacggcacccugcagggcaccacccagcuggugcccacccagaucugcagcuucagaggcacccugaucagccagaccagcagaagcgccgacagcaccgacagcgcccccagagugagaaaccaccccccccacgugcagcugaagaaccuggacggcacccccuacgaccccaccgacgaggugcccgccgugcugggcgccaucgacuucaagggcaccguguucggcguggccagccagagaaacaccaccggcggcagcgugggcgccaccagagcccacgaggugcacaucgacaccaccaaccccagauacacccccaagcugggcagcgugcugauguacagcgagagcgacgacuucgacgacggccagcccaccagauucacccccaucggcaugggcgccgacgacuggcaccagugggagcugcccgaguacagcggccaccugacccugaacaugaaccuggcccccgccguggcccccgccuuccccggcgagagaauccuguucuucagaagcguggugcccagcgccggcggcuacggcagcggccagaucgacugccugaucccccaggagugggugcagcacuucuaccaggaggccgcccccagccagagcgccguggcccugaucagauacgugaaccccgacaccggcagaaacaucuucgaggccaagcugcacagagagggcuucaucaccguggccaacagcggcaacaaccccaucguggugccccccaacggcuacuucagauucgaggccugggugaaccaguucuacacccugacccccaugggcaccggccagggcagaagaagagugcaguga

SEQ ID NO: 23811 - RNA, 1623 nt, Artificial Sequence
  derived and/or modified sequence opt4 from capsid_protein__Norovirus__AGC66788
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugagauucagcaccgacaccgagaacgacuucgagacccaccagaacaccaaguucacccccgugggcgugauccaggacggcggcaccacccacagaaacgagccccagcagugggugcugcccaacuacagcggcagcgacgugcccaacgugcaccuggcccccgccguggcccccaacuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23812 - RNA, 1629 nt, Artificial Sequence
  derived and/or modified sequence opt4 from capsid_protein__Norovirus__AGL96587
augaagauggccagcaacgacgccgcccccagcaacgacggcgccgccagccuggugcccgagggcaucaacgagaccaugccccuggagcccguggccggcgccagcaucgccgcccccguggccggccagaccaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugcccagaauguacaacggcuacgccggcggcguggaggugcaggugcugcuggccggcaacgccuucaccgccggcaagauccuguucgccgccaucccccccaacuuccccguggacaugaucagccccgcccagaucaccaugcugccccaccugaucguggacgugagaacccuggagcccaucaugaucccccugcccgacgugagaaacguguucuaccacuucaacaaccagccccagcccagaaugagacugguggccaugcuguacaccccccugagaagcaacggcagcggcgacgacgugcugaccgugagcugcagagugcugaccagacccacccccgacuucgaguucaucuaccuggugccccccagcguggagagcaagaccaagcccuucacccugcccauccugaccaucagcgagcugaccaacagcagauuccccauccccaucgagcagcuguacaccgcccccaacgagaccaacguggugcagugccagaacggcagaugcacccuggacggcgagcugcagggcaccacccagcugcugagcagcgccgugugcagcuacagaggcagaaccguggccaacaacggcgacaacugggaccagaaccugcugcagcugaccuaccccaacggcgccagcuacgaccccaccgacgaggugcccgccccccugggcacccaggacuucagcggcaugcuguacggcgugcugacccaggacaacgugaacgugagcaccggcgaggccaagaacgccaagggcaucuacaucagcaccaccagcggcaaguucacccccaagaucggcagcaucggccugcacagcaucaccgagcacgugcaccccaaccagcagagcagauucacccccgugggcguggccgugaacgagaacacccccuuccagcagugggugcugccccacuacgccggcagcaccagaagccacaccaaccugggcaccgcccuggcccccaccuuccccggcgagcagcugcuguucuucagaagcagagugcccugcgugcagggccugcagggccaggacgccuucaucgacugccugcugccccaggagugggugaaccacuucuaccaggaggccgcccccagccaggccgacguggcccugaucagauacgugaaccccgacaccggcagaacccuguucgaggccaagcugcacagaagcggcuucaucaccgugagccacaccggcgccuacccccugguggugccccccaacggccacuucagauucgacagcugggugaaccaguucuacagccuggcccccaugggcaccggcaacggcagaagaagaauccaguga

SEQ ID NO: 23813 - RNA, 1623 nt, Artificial Sequence
  derived and/or modified sequence opt4 from capsid_protein__Norovirus__AGQ57036
augaagauggccagcaacgacgccgcccccagcaacgacggcgccgccggccuggugcccgagaucaacaacgaggugaugccccuggagcccguggccggcgccagccuggccacccccguggugggccagcagaacaucaucgaccccuggaucagaaacaacuucgugcaggcccccgccggcgaguucaccgugagccccagaaacagccccggcgagauccugcuggaccuggagcugggccccgagcugaaccccuaccuggcccaccuggccagaauguacaacggccacgccggcggcauggaggugcagaucgugcuggccggcaacgccuucaccgccggcaagaucaucuucgccgccaucccccccggcuuccccuacgagaaccugagccccagccagaucaccaugugcccccacgugaucaucgacgugagacagcuggagcccgugcugcugcccaugcccgacaucagaaacaacuucuuccacuacaaccagggcaacgaccccaagcugagacugguggccaugcuguacaccccccugagagccaacaacagcggcgacgacguguucaccgugagcugcagagugcugaccaagcccagccccgacuucgaguucaccuuccuggugccccccaccguggagagcaagaccaagcaguucacccugcccauccugaagaucagcgagaugaccaacagcagauuccccgugcccguggagaugauguacaccgccagaaacgagaaccagguggugcagccccagaacggcagagugacccuggacggcgagcugcugggcaccaccccccugcuggccgugaacaucugcaaguucaagggcgaggugaucgccaagaacggcgacgugagaagcuacagaauggacauggagaucaccaacaccgacggcacccccaucgaccccaccgaggacacccccggccccaucggcagccccgacuuccagggcauccuguucggcguggccagccagagaaacaagaacgagcagaaccccgccaccagagcccacgaggccgacaucaacaccggcggcgaccaguacgcccccaagcuggcccaggugaaguucuucagcgagagccaggacuucgaggugcaccagcccaccguguucacccccgugggcguggccggcgacgccagccaccccuucagacagugggugcugcccagauacggcggccaccugaccaacaacacccaccuggcccccgccguggccccccuguuccccggcgagcagauccuguucuucagaagccagauccccagcagcggcggccacgagcugggcuacauggacugccuggugccccaggagugggugcagcacuucuaccaggaggccgccaccgcccagagcgagguggcccugaucagauucaucaaccccgacaccggcagagugcuguucgaggccaagcugcacaagcagggcuucaucaccguggcccacaccggcgacaaccccaucgugaugccccccaacggcuacuucagauucgaggccugggugaaccaguucuacagccuggcccccgugggcaccggcaacggcagaagaagaauccaguga

SEQ ID NO: 23814 - RNA, 1623 nt, Artificial Sequence
  derived and/or modified sequence opt4 from capsid_protein__Norovirus__AGT95926
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagugguguga

SEQ ID NO: 23815 - RNA, 1623 nt, Artificial Sequence
  derived and/or modified sequence opt4 from capsid_protein__Norovirus__AGT95927
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaccccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggugaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagugguguga

SEQ ID NO: 23816 - RNA, 1623 nt, Artificial Sequence
  derived and/or modified sequence opt4 from capsid_protein__Norovirus__AGT95928
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugagcaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcaugcugacccagaccaccagagccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagugguguga

SEQ ID NO: 23817 - RNA, 1623 nt, Artificial Sequence
  derived and/or modified sequence opt4 from capsid_protein__Norovirus__AGT95929
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaaagagagugguguga

SEQ ID NO: 23818 - RNA, 1623 nt, Artificial Sequence
  derived and/or modified sequence opt4 from capsid_protein__Norovirus__AGT95930
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcaccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagccguguga

SEQ ID NO: 23819 - RNA, 1623 nt, Artificial Sequence
  derived and/or modified sequence opt4 from capsid_protein__Norovirus__AGT95931
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgagaccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagccguguga

SEQ ID NO: 23820 - RNA, 1623 nt, Artificial Sequence
  derived and/or modified sequence opt4 from capsid_protein__Norovirus__AHC12655
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacgugagcaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccaucggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagugguguga

SEQ ID NO: 23821 - RNA, 1623 nt, Artificial Sequence
  derived and/or modified sequence opt4 from capsid_protein__Norovirus__AHC12658
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccaucccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcggcgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaucaccaaguucacccccaucggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagugguguga

SEQ ID NO: 23822 - RNA, 1632 nt, Artificial Sequence
  derived and/or modified sequence opt4 from capsid_protein__Norovirus__AHW99832
augaugauggccagcaaggacgcccccagcagcgccgacggcgccaacggcgccggccagcuggugcccgaggugaacaacgccgagccccugccccuggaccccguggccggcgccagcaccgcccuggccaccgccggccaggugaacaugaucgaccccuggaucuucaacaacuucgugcaggccccccagggcgaguucaccaucagccccaacaacacccccggcgacauccuguucgaccugcagcugggcccccaccugaaccccuuccuggcccaccugagccagauguacaacggcugggugggcaacaugagagugagagugauccuggccggcaacgccuucaccgccggcaaggugaucaucugcugcgugccccccggcuuccagagcagaacccugagcaucgcccaggccacccuguucccccacaucaucgccgacgugagaacccuggagcccaucgagaucccccuggaggacgugagaaacacccuguaccacaccaacgacaaccagcccaccaugagacugcugugcaugcuguacaccccccugagaaccggcggcggcagcggcggcaccgacgccuucgugguggccggcagagugcugaccugccccagcagcgacuucaacuuccuguuccuggugccccccaccguggagcagaagaccagacccuucagcgugcccaacaucccccugcagcugcugagcaacagcagagugcccaaccugauccagagcauggugcugagccccgaccaggcccagaacgugcaguuccagaacggcagaugcaccaccgacggccagcugcugggcaccacccccgugagcgugagccagauccugaaguucagaggcaaggugagcgccggcagcaaggugaucaaccugaccgagcuggacggcagccccuuccuggccuucgaggcccccgcccccaccggcuuccccgaccugggcaccagcgacuggcacguggagaugagccugaacagcaacagccagagcagcggcaaccccauccugcugagagacauccaccccaacagcagcgaguucgugccccaccugggcagcgugugcgugaccgccgccaucgagguggccggcgacuacaccggcaccauccaguggaccagccagcccagcaacgugacccccgugcccgacgugaacuucuggaccaucccccacuacggcagcaaccuggccgaggccagccagcuggcccccgugguguacccccccggcuucggcgaggccaucguguacuucaugagccccauccccggccccaacaccgcccacaagcccaaccuggugcccugccugcugccccaggaguucgugacccacuucgugagcgagcaggcccccagcaugggcgaggccgcccuggugcacuacguggaccccgacaccaacagaaaccugggcgaguucaagcuguaccccgagggcuucaucaccugcgugcccaacggcaccggcccccagcagcugccccugaacggcguguucguguucgccagcugggugagcagauucuaccagcugaagcccgugggcaccgccagcagcgccagaggcagacugggcgugagaagauga

SEQ ID NO: 23823 - RNA, 1647 nt, Artificial Sequence
  derived and/or modified sequence opt4 from capsid_protein__Norovirus__AHZ12735
augaagauggccagcaacgacgccacccccagcaacgacggcgccgccggccuggugcccgagaucaacaacgaggccauggcccuggagcccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccaggagaucaaccccuaccuggcccaccuggccagaauguacaacggcuacgccggcggcuucgaggugcagguggugcuggccggcaacgccuucaccgccggcaagaucaucuucgccgccaucccccccaacuuccccaucgacaaccugagcgccgcccagaucaccaugugcccccacgugaucguggacgugagacagcuggagcccgugaaccugcccaugcccgacgugagaaacaacuucuuccacuacaaccagggcagcgacagcagacugagacugguggccaugcuguacaccccccugagagccaacaacagcggcgacgacguguucaccgugagcugcagagugcugaccagacccagccccgaguucagcuucaacuuccuggugccccccaccguggagagcaagaccaagcccuucacccugcccauccugaccaucagcgagaugagcaacagcagauuccccgugcccaucgacagccugcacaccagccccaccgagaacaucguggugcagugccagaacggcagagugacccuggacggcgagcugaugggcaccacccagcugcugcccagccagaucugcgccuucagaggcgugcugaccagaagcaccagcagaaccagcgaccaggccgacaccgccacccccagacuguucaacuacuacuggcacauccagcuggacaaccugaacggcacccccuacgaccccgccgaggacauccccggcccccugggcacccccgacuucagaggcaagguguucggcguggccagccagagaaaccccgacagcaccaccagagcccacgaggccaagguggacaccaccgccggcagauucacccccaagcugggcagccuggagaucagcaccgagagcggcgacuucgaccagaaccagcccaccagauucacccccgugggcaucggcguggacagagaggccgacuuccagcaguggagccugcccgacuacagcggccaguucacccacaacaugaaccuggcccccgccguggcccccaacuuccccggcgagcagcugcuguucuucagaagccagcugcccagcagcggcggcagaagcaacggcauccuggacugccuggugccccaggagugggugcagcacuucuaccaggagagcgcccccgcccagacccagguggcccuggugagauacgugaaccccgacaccggcagagugcuguucgaggccaagcugcacaagcugggcuucaugaccaucgccaagaacggcgacagccccaucaccgugccccccaacggcuacuucagauucgagagcugggugaaccccuucuacacccuggcccccaugggcaccggcaacggcagaagaagagugcaguga

SEQ ID NO: 23824 - RNA, 1647 nt, Artificial Sequence
  derived and/or modified sequence opt4 from capsid_protein__Norovirus__AHZ12736
augaagauggccagcaacgacgccacccccagcaacgacggcgccgccggccuggugcccgagaucaacaacgaggccauggcccuggaccccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgccuucaccgccggcaagaucaucuucgccgccaucccccccaacuuccccaucgacaaccugagcgccgcccagaucaccaugugcccccacgugaucguggacgugagacagcuggagcccgugaaccugcccaugcccgacgugagaaacaacuucuuccacuacaaccagggcagcgacagcagacugagacugguggccaugcuguacaccccccugagagccaacaacagcggcgacgacguguucaccgugagcugcagagugcugaccagacccagccccgaguucagcuucaacuuccuggugccccccaccguggagagcaagaccaagcccuucacccugcccauccugaccaucagcgagaugagcaacagcagauuccccgugcccaucgacagccugcacaccagccccaccgagaacaucguggugcagugccagaacggcagagugacccuggacggcgagcugaugggcaccacccagcugcugcccagccagaucugcgccuucagaggcgugcugaccagaagcaccagcagagccagcgaccaggccgacaccgccacccccagacuguucaacuacuacuggcacauccagcuggacaaccugaacggcacccccuacgaccccgccgaggacauccccggcccccugggcacccccgacuucagaggcaagguguucggcguggccagccagagaaaccccgacaacaccaccagagcccacgaggccaagguggacaccaccgccggcagauucacccccaagcugggcagccuggagaucagcaccgagagcggcgacuucgaccagaaccagcccaccagauucacccccgugggcaucggcguggaccacgaggccgacuuccagcaguggagccugcccgacuacagcggccaguucacccacaacaugaaccuggcccccgccguggcccccaacuuccccggcgagcagcugcuguucuucagaagccagcugcccagcagcggcggcagaagcaacggcauccuggacugccuggugccccaggagugggugcagcacuucuaccaggagagcgcccccgcccagacccagguggcccuggugagauacgugaaccccgacaccggcagagugcuguucgaggccaagcugcacaagcugggcuucaugaccaucgccaagaacggcgacagccccaucaccgugccccccaacggcuacuucagauucgagagcugggugaaccccuucuacacccuggcccccaugggcaccggcaacggcagaagaagagugcaguga

SEQ ID NO: 23825 - RNA, 1647 nt, Artificial Sequence
  derived and/or modified sequence opt4 from capsid_protein__Norovirus__AHZ12737
augaagauggccagcaacgacgccgcccccagcaacgacggcgccgccggccuggugcccgagaucaacagcgaggccauggcccuggagcccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgccuucaccgccggcaagaucaucuucgccgccaucccccccaacuuccccaucgacaaccugagcgccgcccagaucaccaugugcccccacgugaucguggacgugagacagcuggagcccgugaaccugcccaugcccgacgugagaaacaacuucuuccacuacaaccagggcagcgacagcagacugagacugaucgccaugcuguacaccccccugagagccaacaacagcggcgacgacguguucaccgugagcugcagagugcugaccagacccagccccgacuucagcuucaacuuccuggugccccccaccguggagagcaagaccaagcccuucagccugcccauccugaccaucagcgagaugagcaacagcagauuccccgugcccaucgacagccugcacaccagccccaccgagaacaucguggugcagugccagaacggcagagugacccuggacggcgagcugaugggcaccacccagcugcugcccagccagaucugcgccuucagaggcacccugaccagaagcaccagcagagccagcgaccaggccgacaccgccacccccagacuguucaacuacuacuggcacauccagcuggacaaccugaacggcacccccuacgaccccgccgaggacauccccggcccccugggcacccccgacuucagaggcaagguguucggcguggccagccagagaaaccccgacgccaccaccagagcccacgaggccaagaucgacaccaccagcggcagauucacccccaagcugggcagccuggagaucagcaccgagagcgacgacuucgaccagaaccagcccaccagauucacccccgugggcgugggcguggaccacgagcccgacuuccagcagugggugcugcccgacuacgccggccaguucacccacaacaugaaccuggcccccgccguggcccccaacuuccccggcgagcagcugcuguucuucagaagccagcugcccagcagcggcggcagaagcaacggcauccuggacugccuggugccccaggagugggugcagcacuucuaccaggagagcgcccccagccagacccagguggcccuggugagauacgugaaccccgacaccggcagagugcuguucgaggccaagcugcacaagcugggcuucaugaccaucgccaagagcggcgacagccccaucaccgugccccccaacggcuacuucagauucgagagcugggugaaccccuucuacacccuggcccccaugggcaccggcaacggcagaagaagaauccaguga

SEQ ID NO: 23826 - RNA, 1647 nt, Artificial Sequence
  derived and/or modified sequence opt4 from capsid_protein__Norovirus__AHZ12738
augaagauggccagcaacgacgccacccccagcaacgacggcgccgccggccuggugcccgagaucaacaacgaggccauggcccuggaccccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgccuucaccgccggcaagaucaucuucgccgccaucccccccaacuuccccaucgacaaccugagcgccgcccagaucaccaugugcccccacgugaucguggacgugagacagcuggagcccgugaaccugcccaugcccgacgugagaaacaacuucuuccacuacaaccagggcagcgacagcagacugagacugguggccaugcuguacaccccccugagagccaacaacagcggcgacgacguguucaccgugagcugcagagugcugaccagacccagccccgaguucagcuucaacuuccuggugccccccaccguggagagcaagaccaagcccuucacccugcccauccugaccaucagcgagaugagcaacagcagauuccccgugcccaucgacagccugcacaccagccccaccgagaacaucguggugcagugccagaacggcagagugacccuggacggcgagcugaugggcaccacccagcugcugcccagccagaucugcgccuucagaggcgugcugaccagaagcaccagcagagccagcgaccaggccgacaccgccacccccagacuguucaacuacuacuggcacauccagcuggacaaccugaacggcacccccuacgaccccgccgaggacauccccggcccccugggcacccccgacuucagaggcaagguguucggcguggccagccagagaaaccccgacagcaccaccagagcccacgaggccaagguggacaccaccgccggcagauucacccccaagcugggcagccuggagaucagcaccgagagcggcgacuucgaccagaaccagcccaccagauucacccccgugggcaucggcguggaccacgaggccgacuuccagcaguggagccugcccgacuacagcggccaguucacccacaacaugaaccuggcccccgccguggcccccaacuuccccggcgagcagcugcuguucuucagaagccagcugcccagcagcggcggcagaagcaacggcauccuggacugccuggugccccaggagugggugcagcacuucuaccaggagagcgcccccgcccagacccagguggcccuggugagauacgugaaccccgacaccggcagagugcuguucgaggccaagcugcacaagcugggcuucaugaccaucgccaagaacggcgacagccccaucaccgugccccccaacggcuacuucagauucgagagcugggugaaccccuucuacacccuggcccccaugggcaccggcaacggcagaagaagagugcaguga

SEQ ID NO: 23827 - RNA, 1647 nt, Artificial Sequence
  derived and/or modified sequence opt4 from capsid_protein__Norovirus__AHZ12739
augaagauggccagcaacgacgccacccccagcaacgacggcgccgccggccuggugcccgagaucaacaacgaggccauggcccuggaccccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgccuucaccgccggcaagaucaucuucgccgccaucccccccaacuuccccaucgacaaccugagcgccgcccagaucaccaugugcccccacgugaucguggacgugagacagcuggagcccgugaaccugcccaugcccgacgugagaaacaacuucuuccacuacaaccagggcagcgacagcagacugagacugguggccaugcuguacaccccccugagagccaacaacagcggcgacgacguguucaccgugagcugcagagugcugaccagacccagccccgaguucagcuucaacuuccuggugccccccaccguggagagcaagaccaagcccuucacccugcccauccugaccaucagcgagaugagcaacagcagauuccccgugcccaucgacagccugcacaccagccccaccgagaacaucguggugcagugccagaacggcagagugacccuggacggcgagcugaugggcaccacccagcugcugcccagccagaucugcgccuucagaggcgugcugaccagaagcaccagcagaaccagcgaccaggccgacaccgccacccccagacuguucaacuacuacuggcacauccagcuggacaaccugaacggcacccccuacgaccccgccgaggacauccccggcccccugggcacccccgacuucagaggcaagguguucggcguggccagccagagaaaccccgacagcaccaccagagcccacgaggccaagguggacaccaccgccggcagauucacccccaagcugggcagccuggagaucagcaccgagagcggcgacuucgaccagaaccagcccaccagauucacccccgugggcaucggcguggaccacgaggccgacuuccagcaguggagccugcccgacuacagcggccaguucacccacaacaugaaccuggcccccgccguggcccccaacuuccccggcgagcagcugcuguucuucagaagccagcugcccagcagcggcggcagaagcaacggcauccuggacugccuggugccccaggagugggugcagcacuucuaccaggagagcgcccccgcccagacccagguggcccuggugagauacgugaaccccgacaccggcagagugcuguucgaggccaagcugcacaagcugggcuucaugaccaucgccaagaacggcgacagccccaucaccgugccccccaacggcuacuucagauucgagagcugggugaaccccuucuacacccuggcccccaugggcaccggcaacggcagaagaagagugcaguga

SEQ ID NO: 23828 - RNA, 1623 nt, Artificial Sequence
  derived and/or modified sequence opt4 from capsid_protein__Norovirus__AHZ12912
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugagcaucugcaccuucagaggcgacgugacccacauccccggcagccacaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccaacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23829 - RNA, 1623 nt, Artificial Sequence; identical to SEQ ID NO: 23828
  derived and/or modified sequence opt4 from capsid_protein__Norovirus__AHZ12913

SEQ ID NO: 23830 - RNA, 1623 nt, Artificial Sequence
  derived and/or modified sequence opt4 from capsid_protein__Norovirus__AHZ12998
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugauccacaucagcggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23831 - RNA, 1623 nt, Artificial Sequence; identical to SEQ ID NO: 23830
  derived and/or modified sequence opt4 from capsid_protein__Norovirus__AHZ13001

SEQ ID NO: 23832 - RNA, 1623 nt, Artificial Sequence; identical to SEQ ID NO: 23830
  derived and/or modified sequence opt4 from capsid_protein__Norovirus__AHZ13004

SEQ ID NO: 23833 - RNA, 1623 nt, Artificial Sequence; identical to SEQ ID NO: 23830
  derived and/or modified sequence opt4 from capsid_protein__Norovirus__AHZ13010

SEQ ID NO: 23834 - RNA, 1623 nt, Artificial Sequence; identical to SEQ ID NO: 23830
  derived and/or modified sequence opt4 from capsid_protein__Norovirus__AHZ13015

SEQ ID NO: 23835 - RNA, 1623 nt, Artificial Sequence; identical to SEQ ID NO: 23830
  derived and/or modified sequence opt4 from capsid_protein__Norovirus__AHZ13020

SEQ ID NO: 23836 - RNA, 1623 nt, Artificial Sequence; identical to SEQ ID NO: 23830
  derived and/or modified sequence opt4 from capsid_protein__Norovirus__AHZ13023

SEQ ID NO: 23837 - RNA, 1545 nt, Artificial Sequence
  derived and/or modified sequence opt4 from capsid_protein__Norovirus__AIC32559
auggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcgcccccgacuucgugggcaagauccagggcaugcugacccagaccaccagagccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagagugguguga

SEQ ID NO: 23838 - RNA, 1617 nt, Artificial Sequence
  derived and/or modified sequence opt4 from capsid_protein__Norovirus__AID51474
auggccagcaacgacgccacccccagcaacgacggcgccgccggccuggugcccgagagcaacaacgaggccauggcccuggagcccguggugggcgccagccuggccgcccccgugaccggccagaccaacaucaucgaccccuggaucagaaccaacuucgugcaggcccccaacggcgaguucaccgugagccccagaaacagccccggcgagauccuggugaaccuggagcugggccccgagcugaaccccuaccuggcccaccuggccagaauguacaacggcuacgccggcggcauggaggugcaggugaugcuggccggcaacgccuucaccgccggcaagaucaucuucgccgccgugccccccuacuuccccguggagaaccugagccccagccagaucaccauguucccccacgugaucaucgacgugagaacccuggagcccgugcugcugcccaugcccgacgugagaagcacccuguuccacuucaaccagaaggacgagcccaagaugagacugguggccaugcuguacaccccccugagaagcaacggcagcggcgacgacguguucaccgugagcugcagaauccugaccagacccagccccgaguucgacuucaccuaccuggugccccccaccguggagagcaagaccaagcccuucacccugcccgugcugacccugggcgagcugagcaacagcagauucccccugagcaucgacgagauggugaccagccccaacgagagcaucguggugcagccccagaacggcagagugacccuggacggcgagcugcugggcaccacccagcugcaggccugcaacaucugcagcaucagaggcaaggugaccggccaggugcccaacgagcagcacauguggaaccuggagaucaccaaccugaacggcacccaguucgaccccaccgacgacgugcccgccccccugggcgugcccgacuucgccggcgagguguucggcgugcugagccagagaaacagaggcgagagcaaccccgccaacagagcccacgacgccgugguggccaccuacagcgacaaguacacccccaagcugggccuggugcagaucggcaccuggaacaccaacgacguggagaaccagcccaccaaguucacccccaucggccugaacgagguggccaacggccacagauucgagcaguggacccugcccagauacagcggcgcccugacccugaacaugaaccuggcccccgccguggccccccuguuccccggcgagagacugcuguucuucagaagcuacgugccccugaagggcggcuucggcaaccccgccaucgacugccuggugccccaggagugggugcagcacuucuaccaggagagcgcccccagccugggcgacguggcccuggugagauacgugaaccccgacaccggcagagugcuguucgaggccaagcugcacaagggcggcuuccugaccgugagcagcaccagcaccggccccgugguggugcccgccaacggcuacuucagauucgacagcugggugaaccaguucuacagccuggcccccaugggcaccggcaacggcagaagaagauuccaguga

SEQ ID NO: 23839 - RNA, 1617 nt, Artificial Sequence; identical to SEQ ID NO: 23838
  derived and/or modified sequence opt4 from capsid_protein__Norovirus__AID51477

SEQ ID NO: 23840 - RNA, 1617 nt, Artificial Sequence; identical to SEQ ID NO: 23838
  derived and/or modified sequence opt4 from capsid_protein__Norovirus__AID51480

SEQ ID NO: 23841 - RNA, 1617 nt, Artificial Sequence; identical to SEQ ID NO: 23838
  derived and/or modified sequence opt4 from capsid_protein__Norovirus__AID51483

SEQ ID NO: 23842 - RNA, 1617 nt, Artificial Sequence; identical to SEQ ID NO: 23838
  derived and/or modified sequence opt4 from capsid_protein__Norovirus__AID51486

SEQ ID NO: 23843 - RNA, 1617 nt, Artificial Sequence; identical to SEQ ID NO: 23838
  derived and/or modified sequence opt4 from capsid_protein__Norovirus__AID51489

SEQ ID NO: 23844 - RNA, 1617 nt, Artificial Sequence; identical to SEQ ID NO: 23838
  derived and/or modified sequence opt4 from capsid_protein__Norovirus__AID51492

SEQ ID NO: 23845 - RNA, 1617 nt, Artificial Sequence; identical to SEQ ID NO: 23838
  derived and/or modified sequence opt4 from capsid_protein__Norovirus__AID51495

SEQ ID NO: 23846 - RNA, 1623 nt, Artificial Sequence
  derived and/or modified sequence opt4 from capsid_protein__Norovirus__AIE40036
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccaucgaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccaucggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23847 - RNA, 1647 nt, Artificial Sequence
  derived and/or modified sequence opt4 from capsid_protein__Norovirus__AJW87644
augaagauggccagcaacgacgccgcccccagcaacgacggcgccgccggccuggugcccgagaucaacaacgaggccauggcccuggagcccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgccuucaccgccggcaagaucaucuucgccgccaucccccccaacuuccccaucgacaaccugagcgccgcccagaucaccaugugcccccacgugaucguggacgugagacagcuggagcccgugaaccugcccaugcccgacgugagaaacaacuucuuccacuacaaccagggcagcgacagcagacugagacugaucgccaugcuguacaccccccugagagccaacaacagcggcgacgacguguucaccgugagcugcagagugcugaccagacccagccccgacuucagcuucaacuuccuggugccccccaccguggagagcaagaccaagcccuucagccugcccauccugaccaucagcgagaugagcaacagcagauuccccgugcccaucgacagccugcacaccagccccaccgagaacaucguggugcagugccagaacggcagagugacccuggacggcgagcugaugggcaccacccagcugcugcccagccagaucugcgccuucagaggcgugcugaucagaagcaccagcagagccagcgaccaggccgacaccgccacccccagacuguucaacuacuacuggcacauccagcuggacaaccugaacggcacccccuacgaccccgccgaggacauccccggcccccugggcacccccgacuucagaggcaagguguucggcguggccagccagagaaaccccgacaccaccaccagagcccacgaggccaagaucgacaccaccagcggcagauucacccccaagcugggcagccuggagaucagcaccgagagcgacgacuucgaccagaacaagcccaccagauucacccccgugggcaucggcguggaccacgaggccgacuuccagcaguggacccugcccgacuacgccggccaguucacccacaacaugaaccuggcccccgccguggcccccaacuuccccggcgagcagcugcuguucuucagaagccagcugcccagcagcggcggcagaagcaacggcauccuggacugccuggugccccaggagugggugcagcacuucuaccaggagagcgcccccagccagagccagguggcccuggugagauacaucaaccccgacaccggcagagugcuguucgaggccaagcugcacaagcugggcuucaucaccaucgccaagaacggcgacagccccaucaccgugccccccaacggcuacuucagauucgagagcugggugaaccccuucuacacccuggcccccaugggcaccggcaacggcagaagaagaauccaguga

SEQ ID NO: 23848 - RNA, 1623 nt, Artificial Sequence
  derived and/or modified sequence opt4 from capsid_protein__Norovirus__ALG05457
augaagauggccagcaacgacgccgcccccagcaacgacggcgccgccggccuggugcccgagggcaacaacgagacccugccccuggagcccguggccggcgccgccaucgccgcccccgugaccggccagaacaacaucaucgaccccuggaucagaaccaacuucgugcaggcccccaacggcgaguucaccgugagccccagaaacagccccggcgagauccugcugaaccuggagcugagccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacagcaaccagcccaacagcagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucagccugcccauccugacccugagcgagcugaccaacagcagauuccccgugcccaucgacagccuguucaccgcccagaacaacgugcugcaggugcagugccagaacggcagaugcacccuggacggcgagcugcagggcaccacccagcugcugcccagcggcaucugcgccuucagaggcagagugaccgcccagaucaaccagagagacagauggcacaugcagcugcagaaccugaacggcaccaccuacgaccccaccgacgacgugcccgccccccugggcacccccgacuucaagggcgugguguucggcauggugagccagagaaacgugggcaacgacgcccccggcagcaccagagcccagcaggccugggugagcaccuacagcccccaguucgugcccaagcugggcagcgugaaccugagaaucagcgacaacgacgacuuccaguuccagcccaccaaguucacccccgugggcgugaacgacgacgacgacggccaccccuucagacagugggagcugcccaacuacagcggcgagcugacccugaacaugaaccuggccccccccguggcccccaacuuccccggcgagcagcugcuguucuucagaagcuucgugcccugcagcggcggcuacaaccagggcaucaucgacugccugaucccccaggaguggauccagcacuucuaccaggagagcgcccccagccagagcgacguggcccugaucagauacgugaaccccgacaccggcagaacccuguucgaggccaagcugcacagaagcggcuacaucaccguggcccacagcggcgacuacccccugguggugcccgccaacggccacuucagauucgacagcugggugaaccaguucuacagccuggcccccaugggcaccggcaacggcagaagaagagcccaguga

SEQ ID NO: 23849 - RNA, 1623 nt, Artificial Sequence
  derived and/or modified sequence opt4 from capsid_protein__Norovirus__ALG05460
augaagauggccagcaacgacgccgcccccagcaacgacggcgccgccggccuggugcccgagggcaacgacgagacccugccccuggagcccguggccggcgccgccaucgccgcccccgugaccggccagaacaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacugcagcaaccagcccaacagcagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucagccugcccauccugacccugagcgagcugaccaacagcagauuccccgugcccaucgacagccuguucaccgcccagaacaacgugcugcaggugcagugccagaacggcagaugcacccuggacggcgagcugcagggcaccacccagcugcugcccagcggcaucugcgccuucagaggcagagugaccgcccagaucaaccagagagacagauggcacaugcagcugcagaaccugaacggcaccaccuacgaccccaccgacgacgugcccgccccccugggcacccccgacuucaagggcgugguguucggcauggugagccagagaaacgugggcaacgacgcccccggcagcaccagagcccagcaggccugggugagcaccuacagcccccaguucgugcccaagcugggcagcgugaaccugagaaucagcgacaacgacgacuuccaguuccagcccacccaguucacccccgugggcgugaacgacgacgacgacggccaccccuucagacagugggagcugcccaacuacagcggcgagcugacccugaacaugaaccuggccccccccguggcccccaacuuccccggcgagcagcugcuguucuucagaagcuucgugcccugcagcggcggcuacaaccagggcaucaucgacugccugaucccccaggaguggauccagcacuucuaccaggagagcgcccccagccagagcgacguggcccugaucagauacgugaaccccgacaccggcagaacccuguucgaggccaagcugcacagaagcggcuacaucaccguggcccacagcggcgacuacccccugguggugcccgccaacggccacuucagauucgacagcugggugaaccaguucuacagccuggcccccaugggcaccggcaacggcagaagaagagcccaguga

SEQ ID NO: 23850 - RNA, 1623 nt, Artificial Sequence
  derived and/or modified sequence opt4 from capsid_protein__Norovirus__ALL73873
augaagauggccagcaacgacgccgcccccagcaacgacggcgccgccggccuggugcccgagggcaacaacgagacccugccccuggagcccguggccggcgccgccaucgccgcccccgugaccggccagaacaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacagcaaccagcccaacagcagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucagccugcccauccugacccugagcgagcugaccaacagcagauuccccgugcccaucgacagccuguucaccgcccagaacaacgugcugcaggugcagugccagaacggcagaugcacccuggacggcgagcugcagggcaccacccagcugcugcccagcggcaucugcgccuucagaggcagagugaccgcccagaucaaccagagagacagauggcacaugcagcugcagaaccugaacggcaccaccuacgaccccaccgacgacgugcccgccccccugggcacccccgacuucaagggcgugguguucggcauggugagccagagaaacgugggcagcgacgcccccggcagcaccagagcccagcaggccugggugagcaccuacagcccccaguucgugcccaagcugggcagcgugaaccugagaaucagcgacaacgacgacuuccaguuccagcccaccaaguucacccccgugggcgugaacgacgacgacgacggccaccccuucagacagugggagcugcccaacuacagcggcgagcugacccugaacaugaaccuggccccccccguggcccccaacuuccccggcgagcagcugcuguucuucagaagcuucgugcccugcagcggcggcuacaaccagggcaucaucgacugccugaucccccaggaguggauccagcacuucuaccaggagagcgcccccagccagagcgacguggcccugaucagauacgugaaccccgacaccggcagaacccuguucgaggccaagcugcacagaagcggcuacaucaccguggcccacagcggcgacuacccccugguggugcccgccaacggccacuucagauucgacagcugggugaaccaguucuacagccuggcccccaugggcaccggcaacggcagaagaagagcccaguga

SEQ ID NO: 23851 - RNA, 1623 nt, Artificial Sequence; identical to SEQ ID NO: 23050
  derived and/or modified sequence opt4 from capsid_protein__Norovirus__ALL73876

SEQ ID NO: 23852 - RNA, 1623 nt, Artificial Sequence
  derived and/or modified sequence opt4 from capsid_protein__Norovirus__ALL73879
augaagauggccagcaacgacgccgcccccagcaacgacggcgccgccggccuggugcccgagggcaacaacgagacccugccccuggagcccguggccggcgccgccaucgccgccagcgugaccggccagaacaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacagcaaccagcccaacagcagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucagccugcccauccugacccugagcgagcugaccaacagcagauuccccgugcccaucgacagccuguucaccgcccagaacaacgugcugcaggugcagugccagaacggcagaugcacccuggacggcgagcugcagggcaccacccagcugcugcccagcggcaucugcgccuucagaggcagagugaccgcccagaucaaccagagagacagauggcacaugcagcugcagaaccugaacggcaccaccuacgaccccaccgacgacgugcccgccccccugggcacccccgacuucaagggcgugguguucggcauggugagccagagaaacgugggcaacgacgcccccggcagcaccagagcccagcaggccugggugagcaccuacagcccccaguucgugcccaagcugggcagcgugaaccugagaaucagcgacaacgacgacuuccaguuccagcccaccaaguucacccccgugggcgugaacgacgacgacgacggccaccccuucagacagugggagcugcccaacuacagcggcgagcugacccugaacaugaaccuggccccccccguggcccccaacuuccccggcgagcagcugcuguucuucagaagcuucgugcccugcagcggcggcuacaaccagggcaucaucgacugccugaucccccaggaguggauccagcacuucuaccaggagagcgcccccagccagagcgacguggcccugaucagauacgugaaccccgacaccggcagaacccuguucgaggccaagcugcacagaagcggcuacaucaccguggcccacagcggcgacuacccccugguggugcccgccaacggccacuucagauucgacagcugggugaaccaguucuacagccuggcccccaugggcaccggcaacggcagaagaagagcccaguga

SEQ ID NO: 23853 - RNA, 1623 nt, Artificial Sequence; identical to SEQ ID NO: 23050
  derived and/or modified sequence opt4 from capsid_protein__Norovirus__ALL73882

SEQ ID NO: 23854 - RNA, 1623 nt, Artificial Sequence; identical to SEQ ID NO: 23050
  derived and/or modified sequence opt4 from capsid_protein__Norovirus__ALL73888

SEQ ID NO: 23855 - RNA, 1623 nt, Artificial Sequence
  derived and/or modified sequence opt4 from capsid_protein__Norovirus__ALQ43927
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagccacaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagaccccuguga

SEQ ID NO: 23856 - RNA, 1623 nt, Artificial Sequence
  derived and/or modified sequence opt4 from capsid_protein__Norovirus__ALQ43928
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagaccccuguga

SEQ ID NO: 23857 - RNA, 1623 nt, Artificial Sequence; identical to SEQ ID NO: 22409
  derived and/or modified sequence opt4 from capsid_protein__Norovirus__ALQ44123

SEQ ID NO: 23858 - RNA, 1623 nt, Artificial Sequence; identical to SEQ ID NO: 23050
  derived and/or modified sequence opt4 from capsid_protein__Norovirus__ALQ44124

SEQ ID NO: 23859 - RNA, 1623 nt, Artificial Sequence; identical to SEQ ID NO: 23050
  derived and/or modified sequence opt4 from capsid_protein__Norovirus__ALQ44125

SEQ ID NO: 23860 - RNA, 1644 nt, Artificial Sequence
  derived and/or modified sequence opt4 from capsid_protein__Norovirus__BAB83514
augaagauggccagcagcgacgccgcccccagcaccgacggcagcgccggccuggugcccgaggugaacaacgagaccauggcccuggagcccguggugggcgccccccuggccgcccccguggccggccagcacaacaucaucgaccccuggaucaagaugaacuucgugcaggcccccaacggcgaguucaccgugagccccagaaacgcccccggcgagauccugcuggaccuggagcugggccccgaccugaaccccuaccugagccaccuggccagaauguacaacggcuacgccggcggcauggaggugcagguggugcuggccggcaacgccuucaccgccggcaagaucaucuucgccgccgugccccccaacuuccccgccgagaaccugagcgccgcccaggugaccaugugcccccacgugaucguggacgugagacagcuggagcccgugaugcugcccaugcccgacaucagaaacaagcuguuccacuacaaccagguggacgaccccaagcugagacugcuggccuaccuguacaccccccugagagccaacaacgccggcgacgacguguucaccgugagcugcagagugcugaccagacccacccccgacuucgaguucauguuccuggugccccccaccguggagagcaagaccaagcccuucagccugcccagccugacccuggacgagcugagcaacagcagauuccccgcccccaucgugcagcuguacaccaacccccacgacaaccugguggugcagccccagaacggcagaugcaccaucgacggccugcugcagggcaccacccagcuggugagcugcaacgugugcagcuucagaggcaccaucggcgacggccagcccgccagccacagcgaggaggagaucaugcccauggccuucaacauccagagagagaucaugcuggagaaccuggacggcacccccuacgaccccgccgacgacauccccgccgugcugggcagccccgacuuccagggcgugaucuucggcauccugagccagagaaacaccgacggccagaccagagcccacgaggccaagguggacaccagagccgccagauucgcccccaagcugggcuucgugguggccaccguggagagcaccgacuuccacgccaaccagcccagcagauucacccccgugggccugggcggcgacaacaaccaggacuucaaccaguggagacugcccgccuacggcggcgcccugaccaacaacaccaaccuggccccccccgugaugcccguguaccccggcgagcagcugcuguucuucagaagccagcugcccagcagcggcggcguggugggcggcuggcuggacugccugcugccccaggagugggugcagcacuucuuccaggagagcgccaccagccagagcgacguggcccuggugagauacaucaaccccaccaccggcagagugcuguucgaggccaagcugcacaagcagggcuuccugaccguggccgccagcggcagcuacccccugguggugcccgccgacggcuacuucagauucgagagcugggugaaccaguucuacacccuggcccccaugggcaacggcagcggcagaagaagagccagauga

SEQ ID NO: 23861 - RNA, 1644 nt, Artificial Sequence
  derived and/or modified sequence opt4 from capsid_protein__Norovirus__BAB83516
augaagauggccagcagcgacgccccccccagcaccgacggcagcgccggccuggugcccgaggugaacaacgagaccauggcccuggagcccguggugggcgccccccuggccgcccccguggccggccagcacaacaucaucgaccccuggaucaagaugaacuucgugcaggcccccaacggcgaguucaccgugagccccagaaacgcccccggcgagauccugcuggaccuggagcugggccccgaccugaaccccuaccugagccaccuggccagaauguacaacggcuacgccggcggcauggaggugcagguggugcuggccggcaacgccuucaccgccggcaagaucaucuucgccgccgugccccccaacuuccccgccgagaaccugagcgccgcccaggugaccaugugcccccacgugaucguggacgugagacagcuggagcccgugaugcugcccaugcccgacaucagaaacaagcuguuccacuacaaccagguggacgaccccaagcugagacugcuggccuaccuguacaccccccugagagccaacaacgccggcgacgacguguucaccgugagcugcagagugcugaccagacccacccccgacuucgaguucauguuccuggugccccccaccguggagagcaagaccaagcccuucagccugcccggccugacccuggacgagcugagcaacagcagauuccccgcccccaucgugcagcuguacaccaacccccacgacaaccugaucgugcagccccagaacggcagaugcaccaucgacggccugcugcagggcaccacccagcuggugagcugcaacgugugcagcuucagaggcaccaugggcgagggccagcccgccgcccacagcgaggacgagaucaugcccauggccuucaacgugcagagagagaucaugcuggagaaccuggacggcagccccuacgaccccaccgacgacauccccgccgugcugggcagccccgacuuccagggcgugauguucggcauccugagccagagaaacaccgacggccagaccagagcccacgaggccaagguggacaccagagccgccagauucgcccccaagcugggcuucgugguggccaccguggagagcaccgacuuccacgccaaccagcccagcagauucacccccgugggccugggcggcgacaccaacagagacuucaaccaguggcagcugcccgccuacggcggcgcccugaccaacaacaccaaccuggccccccccgugaugcccguguaccccggcgagcagcugcuguucuucagaagccagcugcccagcagcggcggcgugguggccggcuggcuggacugccugcugccccaggagugggugcagcacuucuuccaggagagcgccaccagccagagcgacguggcccuggugagauacgugaaccccaccaccggcagagugcuguucgaggccaagcugcacaagcagggcuuccugaccguggccgccagcggcagcuacccccugguggugcccgccgacggcuacuucagauucgagagcugggugaaccaguucuacacccuggcccccaugggcaacggcagcggcagaagaagagccagauga

SEQ ID NO: 23862 - RNA, 1629 nt, Artificial Sequence
  derived and/or modified sequence opt4 from capsid_protein__Norovirus__BAD72797
augaagauggccagcaacgacgccgcccccagcaccgacggcgccgccggccuggugcccgagagcaacaacgaggugauggcccuggagcccguggccggcgccgcccuggccgcccccgugaccggccagaccaacaucaucgaccccuggaucagagccaacuucgugcaggcccccaacggcgaguucaccgugagccccagaaacgcccccggcgaggugcugcugagccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccguggagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauuccccgugagcaucgaccagauguacaccagccccaacgaggugaucagcgugcagugccagaacggcagaugcacccuggacggcgagcugcagggcaccacccagcugcaggugagcggcaucugcgccuucaagggcgaggugaccgcccaccugcacgacaacgaccaccuguacaacgugaccaucaccaaccugaacggcccccccuucgaccccagcgaggacauccccgccccccugggcgugcccgacuuccagggcagaguguucggcgugaucagccagagagacaagcagaacgccgccggccacagcgagcccgccaacagaggccacgacgccguggugcccaccuacaccgcccaguacacccccaagcugggccaggugcagaucggcaccuggcagaccgacgaccugcaggugaaccagcccgugaaguucacccccgugggccugaacgacaccgagcacuucaaccaguggguggugcccagauacgccggcgcccugaaccugaacaccaaccuggcccccagcguggcccccguguuccccggcgagagacugcuguucuucagaagcuacaucccccugaagggcggcuacggcaaccccgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucgugaccgugagcagcaacaccagcgcccccgugguggugcccgccaacggcuacuucagauucgacagcugggugaaccaguucuacagccuggcccccaugggcgccggcaacggcagaagaagagugcaguga

SEQ ID NO: 23863 - RNA, 1647 nt, Artificial Sequence
  derived and/or modified sequence opt4 from capsid_protein__Norovirus__BAD72798
augaagauggccagcaacgacgccgcccccagcaacgacggcgccgccggccuggugcccgagaucaacaacgaggccauggcccuggaccccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgccuucaccgccggcaagaucaucuucgccgccaucccccccaacuuccccaucgacaaccugagcgccgcccagaucaccaugugcccccacgugaucguggacgugagacagcuggagcccgugaaccugcccaugcccgacgugagaaacaacuucuucuacuacaaccagggcagcgacagcagacugagacugaucgccaugcuguacaccccccugagagccaacaacagcggcgacgacguguucaccgugagcugcagagugcugaccagacccagccccgacuucagcuucaacuuccuggugccccccaccguggagagcaagaccaagcccuucacccugcccauccugaccaucagcgagaugagcaacagcagauuccccgugcccaucgagagccugcacaccagccccaccgagaacaucguggugcagugccagaacggcagagugacccuggacggcgagcugaugggcaccacccagcugcugcccagccagaucugcgccuucagaggcgugcugaccagaagcaccagcagagccagcgaccaggccgacaccgccacccccagacuguucaacuacuacuggcacgugcagcuggacaaccugaacggcacccccuacgaccccgccgaggacauccccggcccccugggcacccccgacuucagaggcaagguguucggcguggccagccagagaaaccccgacagcaccaccagagcccacgaggccaagguggacaccaccgccggcagauucacccccaagcugggcagccuggagaucagcaccgagagcagcgacuucgaccagaaccagcccaccagauucacccccgugggcaucggcguggacaacgaggccgacuuccagcaguggagccugcccgacuacagcggccaguucacccacaacaugaaccuggcccccgccguggcccccaacuuccccggcgagcagcugcuguucuucagaagccagcugcccagcagcggcggcagaagcaacggcgugcuggacugccuggugccccaggagugggugcagcacuucuaccaggagagcgcccccgcccagacccagguggcccuggugagauacgugaaccccgacaccggcagagugcuguucggcgccaagcugcacaagcugggcuucaugaccaucgccaagaacggcgacagccccaucaccgugccccccaacggcuacuucagauucgagagcugggugaaccccuucuacacccuggcccccaugggcaccggcaacggcagaagaagaauccaguga

SEQ ID NO: 23864 - RNA, 1647 nt, Artificial Sequence
  derived and/or modified sequence opt4 from capsid_protein__Norovirus__BAD72799
augaagauggccagcaacgacgccgcccccagcaacgacggcgccgccggccuggugcccgagagcaacaacgaggugauggcccuggagcccguggccggcgccagccuggccgcccccgugaccggccagaccaacaucaucgaccccuggaucagaaugaacuucgugcaggcccccaacggcgaguucaccgugagccccagaaacagccccggcgaggugcugcugaaccuggagcugggccccgagcugaaccccuaccuggcccaccugagcagaauguacaacggcuacgccggcggcauggaggugcagaucaugcuggccggcaacgccuucaccgccggcaagcugaucuucgccgccgugcccccccacuuccccaucgagaaccugagccccccccagaucaccauguucccccacgugaucaucgacgugagaacccuggagcccgugcugcugcccaugcccgacaucagaaacagcuucuuccacuucauccagagagacgagcccaagaugagacugguggccaugcuguacaccccccugagaagcaacggcagcggcgacgacguguucaccgugagcugcagagugcugaccagacccacccccgacuucgacuucaccuaccuggugccccccaccguggagagcaagagcaagcccuucacccugcccauccugacccugggcgagcugaccaacagcagauucccccugcccaucgacgugcuguacaccaaccccaacgagagcgccaucgugcagugccagaacggcagaugcacccugggcggcgagcugcagggcaccgcccagcugcugcccaccggcaucugcgccuucagaggcaaggugacccagcaggugcaggacgagcacagaggcacccacuggaacaugaccgugaccaagcugaacggcacccccuucgaccccaccgaggacgugcccgccccccugggcacccccgacuucagcggccagaucuacggcgugaucagccagagaaacaccaacaccgugcccggcgagggcaaccugcccgccaacagagcccacgaggccgugaucgccaccuacagccccaaguucacccccaagcugggcaacauccaguucagcaccugggagacccaggacgugagcagcggccagcccaccaaguucacccccgugggccuggccagcguggacgccaacagccacuucgaccaguggacccugcccagcuacagcggcgcccugacccugaacaugaaccuggcccccagcguggcccccguguuccccggcgagugccugcuguucuucagaagcuucaucccccugaagggcggcuacggcaaccccgccaucgacugccugaugccccaggagugggugcagcaccuguaccaggagagcgcccccagccugagcgacguggcccuggugagauacgugaaccccgagaccggcagaacccuguucgaggccaagcugcacagaaacggcuuccugaccguggccagaaacagcgccggccccgugguggcccccaccaacggcuacuucagauucgacagcugggugaaccaguucuacacccuggcccccaugggcaacggcagcggcagaagaagaauccaguga

SEQ ID NO: 23865 - RNA, 1623 nt, Artificial Sequence
  derived and/or modified sequence opt4 from capsid_protein__Norovirus__BAD72800
augaagauggccagcaacgacgccgcccccagcaacgacggcgccgccggccuggugcccgaggugaacaacgagaccauggcccuggagcccguggccggcgccagcaucgccgccccccugaccggccagaacaacgugaucgaccccuggaucagacugaacuucgugcaggcccccaacggcgaguucaccgugagccccagaaacagccccggcgagauccugcugaaccuggagcugggccccgagcugaaccccuaccuggcccaccuggccagaauguacaacggcuacgccggcggcguggaggugcaggugcugcuggccggcaacgccuucaccgccggcaagcugguguucgccgccauccccccccacuuccccguggacaaccugagccccggccagaucaccauguucccccacgugaucaucgacgugagaacccuggagcccgugcugcugccccugcccgacgugagaaacaacuucuuccacuacaaccagcagagcgaccagagaaugagacugaucgccaugcuguacaccccccugagaagcaacggcagcggcgacgacguguucaccgugagcugcagagugcugaccagacccagccccgacuuccacuuccacuaccuggugccccccaccguggagagcaagaccaagcccuucagcgugcccgugcugacccugaacgagcugaccaacagcagauuccccgugcccaucgacgccauguacaccagccccaacgacagcaucguggugcagccccagaacggcagagccaccaucgacggcgagcugcugggcaccacccagcugauccccagcggcaucugcagcuucagaggcaagaucaccacccaccuggccgacgacagacaccuguggaacauccaggugagcaaccugaacggcacccccuucgaccccaccgacgacgugcccgccccccugggcaugcccgacuucagcggccagaucuucggcguggugagcgagagagacaccggcaccaaccccgccaacagagcccacgacgccgugcuggccaccuacagcgccaaguacacccccaagcugggcagcgugcagaucggcaccugggacaccgaggaccugcuggagagacagcccgugaaguucacccccgugggccugaacgagaucggccaggacaagcacuucgaccagugggugcugcccaacuacagcggcgcccugggccugaacaugcaccuggcccccgccgugagcccccuguuccccggcgagagacugcuguucuucagaagcuacaucccccugaagggcggccacggcgaccccuucaucgacugccuggugccccaggaguggauccagcacuucuaccaggagagcgcccccgcccagagcagcguggcccugcugagauacgugaaccccgacaccggcagaacccuguucgaggccaagcugcacaaggagggcuucaucaccgugagcagcaccgagaacagacccgugaucgugccccccaacggcuacuucagauucgacagcugggugaaccaguucuacagccuggcccccaugggcaccggcaacggcagaagaagaauccaguga

SEQ ID NO: 23866 - RNA, 1620 nt, Artificial Sequence
  derived and/or modified sequence opt4 from capsid_protein__Norovirus__BAD88558
augaagauggccagcaacgacgugaaccccagcgacggcagcgccgccaaccuggugcccgaggugaacaacgaggugauggcccuggagcccguggugggcgccgccaucgccgcccccguggccggccagcagaacaucaucgaccccuggaucagaaacaacuucgugcaggcccccggcggcgaguucaccgugagccccagaaacgcccccggcgagauccuguggagcgccccccugggccccgaccugaaccccuaccugagccaccugagcagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccaggcccacgacagcacccugaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagagcuucaccgugcccgugcugaccguggaggagaugaccaacagcagauuccccaucccccuggagaagcuguacaccggccccagcagcgccuucguggugcagccccagaacggcagaugcaccaccgacggcgugcugcugggcaccacccagcugagcgccgugaacaucugcaccuucagaggcgacgugacccacaucgccggcagcagaaacuacaccaugaaccuggccagccagaacuggaacaacuacgaccccaccgaggagauccccgccccccugggcauccccgacuucgugggcaagauccagggccugcugacccagaccaccagagccgacggcagcaccagagcccacaaggccaccgugagcaccggcagcgugcacuucacccccaagcugggcagcgugcaguucagcaccgacaccgacaacgacuuccagcccggccagaacaccaaguucacccccgugggcgugauccaggacggcgacagacaccagaacgagccccagcagugggugcugcccgacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcugcacuucuaccaggagagcgcccccgcccagagcgacguggcccugcugagauucgugaaccccgacaccaacagagugcuguucgagugcaagcugcacaagagcggcuacaucaccguggcccacaccggccagcacgaccugauccugccccccaacggcuacuucagauucgacagcugggugaaccaguucuacacccuggcccccaugggcaacggcgccggcagaagaagagcccccuga

SEQ ID NO: 23867 - RNA, 1623 nt, Artificial Sequence
  derived and/or modified sequence opt4 from capsid_protein__Norovirus__BAD98240
augaagauggccagcaacgacgccacccccagcaacgacggcgccgccggccuggugcccgagagcaacaacgaggccauggcccuggagcccguggugggcgccagccuggccgcccccgugaccggccagaccaacaucaucgaccccuggaucagaaccaacuucgugcaggcccccaacggcgaguucaccgugagccccagaaacagccccggcgagauccuggugaaccuggagcugggccccgagcugaaccccuaccuggcccaccuggccagaauguacaacggcuacgccggcggcauggaggugcaggugaugcuggccggcaacgccuucaccgccggcaagaucaucuucgccgccgugccccccuacuuccccguggagaaccugagccccagccagaucaccauguucccccacgugaucaucgacgugagaacccuggagcccgugcugcugcccaugcccgacgugagaagcacccuguuccacuucaaccagaaggacgagcccaagaugagacugguggccaugcuguacaccccccugagaagcaacggcagcggcgacgacguguucaccgugagcugcagaauccugaccagacccagccccgaguucgacuucaccuaccuggugccccccaccguggagagcaagaccaagcccuucacccugcccgugcugacccugggcgagcugagcaacagcagauucccccugagcaucgacgagauggugaccagccccaacgagagcaucguggugcagccccagaacggcagagugacccuggacggcgagcugcugggcaccacccagcugcaggccugcaacaucugcagcaucagaggcaaggugaccggccaggugcccaacgagcagcacauguggaaccuggagaucaccaaccugaacggcacccaguucgaccccaccgacgacgugcccgccccccugggcgugcccgacuucgccggcgagguguucggcgugcugagccagagaaacagaggcgagagcaaccccgccaacagagcccacgacgccgugguggccaccuacagcgacaaguacacccccaagcugggccuggugcagaucggcaccuggaacaccaacgacguggagaaccagcccaccaaguucacccccaucggccugaacgagguggccaacggccacagauucgagcaguggacccugcccagauacagcggcgcccugacccugaacaugaaccuggcccccgccguggccccccuguuccccggcgagagacugcuguucuucagaagcuacgugccccugaagggcggcuucggcaaccccgccaucgacugccuggugccccaggagugggugcagcacuucuaccaggagagcgcccccagccugggcgacguggcccuggugagauacgugaaccccgacaccggcagagugcuguucgaggccaagcugcacaagggcggcuuccugaccgugagcagcaccagcaccggccccgugguggugcccgccaacggcuacuucagauucgacagcugggugaaccaguucuacagccuggcccccaugggcaccggcaacggcagaagaagauuccaguga

SEQ ID NO: 23868 - RNA, 1632 nt, Artificial Sequence
  derived and/or modified sequence opt4 from capsid_protein__Norovirus__BAE43833
augaugauggccagcaaggacgcccccaccaacauggacggcaccagcggcgccggccagcuggugcccgaggccagcaccgccgagcccaucagcauggagcccguggccggcgccgccaccgccgccgccaccgccggccaggugaacaugaucgaccccuggaucaugagcaacuacgugcaggccccccagggcgaguucaccaucagccccaacaacacccccggcgacauccuguucgaccugcagcugggcccccaccugaaccccuuccugagccaccuggcccagauguacaacggcugggugggcaacaugaaggugagagugcugcuggccggcaacgccuucaccgccggcaagaucaucaucagcugcgugccccccggcuucgccgcccagaacgugagcaucgcccaggccaccauguucccccacgugaucgccgacgugagagugcuggagcccaucgaggugccccuggaggacgugagaaacgugcuguuccacaacaacgacagcacccccaccaugagacugaucugcaugcuguacaccccccugagagccagcggcagcagcagcggcaccgaccccuucgugaucgccggcagagugcugaccugccccagccccgacuucaacuuccuguuccuggugccccccaacguggagcagaagaccaagcccuucagcgugcccaaccugccccugaacgugcugagcaacagcagagugcccagccugaucaagagcaugauggugagccaggaccacggccagauggugcacuuccagaucggcagagugacccuggacggccagcugcagggcaccacccccaccagcgccagccagcugugcaagaucagaggcaccguguaccacgccaccggcggccagggccugaaccugaccgagaucgacggcacccccuaccacgccuucgagagccccgcccccaucggcuuccccgaccugggcgagugcgacuggcacaucaacgccagccccgccaacgccuucaccgacggcagcaucauccacagaaucgacguggcccaggacagcaccuucgccccccaccugggcaccauccacuacaccaacgccaacuacgacgccaacgugagccugaucugcagccuggaguggcugagcccccccagcggcggcgcccccaaggugaaccccugggccauccccagauacggcagcacccugaccgaggccgcccagcuggccccccccaucuacccccccggcuucggcgaggccaucguguucuucaugagcgacuuccccaucgccaacggcagcgacggccugagcgugcccugcaccaucccccaggaguucgugacccacuucgugaacgagcaggcccccaccagaggcgaggccgcccugcugcacuacguggaccccgacacccacagaaaccugggcgaguucaagcuguaccccgagggcuucaugaccugcgugcccaacagcagcggcagcggcccccagacccugcccaucaacggcguguucaccuucaucagcugggugagcagauucuaccagcugaagcccgugggcaccaccggccccgugagaagacugggcaucagaagaagcuga

SEQ ID NO: 23869 - RNA, 1647 nt, Artificial Sequence
  derived and/or modified sequence opt4 from capsid_protein__Norovirus__BAE48588
augaagauggccagcaacgacgccacccccagcaacgacggcgccgccggccuggugcccgagaucaacaacgaggccauggcccuggaccccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgccuucaccgccagaaagaucaucuucgccgccaucccccccaacuuccccaucgacaaccugagcgccgcccacaucaccaugugcccccacgugaucguggacgugagacagcuggagcccgugaaccugcccaugcccgacgugagaaacaacuucuuccacuacaaccagggcagcgacagcagacugagacugaucgccaugcuguacaccccccugagagccaacaacagcggcgacgacguguucaccgugagcugcagagugcugaccagacccagccccgacuucagcuucaacuuccuggugccccccacccuggagagcaagaccaagcccuucacccugcccauccugaccaucagcgagaugagcaacagcagauuccccgugcccaucgacagccugcacaccagccccaccgagaacaucguggugcagugccagaacggcagagugacccuggacggcgagcugaugggcaccacccagcugcugcccagccagaucugcgccuucagaggcgugcugaccagaagcaccagcagagccagagaccaggccgacaccgccacccccagacuguucaacuacuacuggcacauccagcuggacaaccugaacggcacccccuacgaccccgccgaggacauccccggcccccugggcacccccgacuucagaggcaagguguucggcguggccagccagagaaaccccgacagcaccaccagagcccacgaggccaagguggacaccaccgccggcagauucacccccaagcugggcagccuggagaucagcaccgagagcgacgacuucgaccagaaccagcccaccagauucacccccgugggcaucggcguggacaacgaggccgacuuccagcaguggagccugcccgacuacagcggccaguucacccacaacaugaaccuggcccccgccguggcccccaacuuccccggcgagcagcugcuguucuucagaagccagcugcccagcagcggcggcagaagcaacggcauccuggacugccuggugccccaggagugggugcagcacuucuaccaggagagcgcccccagccagacccagguggcccuggugagauacgugaaccccgacaccggcagagugcuguucgaggccaagcugcacaagcugggcuucaccaccaucgccaagaacggcgacagccccaucaccgugccccccaacggcuacuucagauucgagagcugggugaaccccuucuacacccuggcccccaugggcaccggcaacggcagaagaagaaaccaguga

SEQ ID NO: 23870 - RNA, 1647 nt, Artificial Sequence
  derived and/or modified sequence opt4 from capsid_protein__Norovirus__BAE48589
augaagauggccagcaacgacgccacccccagcaacgacggcgccgccggccuggugcccgagaucaacaacgaggccauggcccuggaccccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgccuucaccgccggcaagaucaucuucgccgccaucccccccuacuuccccaucgacaaccugagcgccgcccagaucaccaugugcccccacgugaucguggacgugagacagcuggagcccgugaaccugcccaugcccgacgugagaaacaacuucuuccacuacaaccagggcagcgacagcagacugagacugguggccaugcuguacaccccccugagagccaacaacagcggcgacgacguguucaccgugagccugagagugcugaccagacccagccccgacuucagcuucaacuuccuggugccccccaccguggagagcaagaccaagcccuucacccugcccauccugaccaucagcgagaugagcaacagcagauuccccgugcccaucgacagccugcacaccagccccaccgagaacaucguggugcagugccagaacggcagagugacccuggacggcgagcugaugggcaccacccagcugcugcccagccagaucugcgccuucagaggcgugcugaccagaagcaccagcagagccagcgaccaggccgacaccgccacccccagacuguucaacuacuacuggcacauccagcuggacaaccugaacggcacccccuacgaccccgccgaggacauccccggcccccugggcacccccgacuucagaggcaagguguucggcguggccagccagagaaaccccgacagcaccaccagagcccacgaggccaagguggacaccaccgccggcagauucacccccaagcugggcagccuggagaucagcaccgagagcgacgacuucgaccagaaccagcccaccagauucacccccgugggcaucggcguggaccacgaggccgacuuccagcaguggagccugcccgacuacagcggccaguucacccacaacaugaaccuggcccccgccguggcccccaacuuccccggcgagcagcugcuguucuucagaagccagcugcccagcagcggcggcagaagcaacggcauccuggacugccuggugccccaggagugggugcagcacuucuaccaggagagcgcccccgcccagacccagguggcccuggugagauacgugaaccccgacaccggcagagugcuguucgaggccaagcugcacaagcugggcuucaugaccaucgccaagaacggcgacagccccaucaccgugccccccaacggcuacuucagauucgagagcugggugaaccccuucuacacccuggcccccaugggcaccggcaacggcagaagaagaauccaguga

SEQ ID NO: 23871 - RNA, 1647 nt, Artificial Sequence
  derived and/or modified sequence opt4 from capsid_protein__Norovirus__BAE48590
augaagauggccagcaacgacgccacccccagcaacgacggcgccgccggccuggugcccgagaucaacaacgaggccauggcccuggaccccguggccggcgccgccaucgccgccccccugaccggccagcagaacaucaucgaccccuggaucaugaacaacuucgugcaggcccccggcggcgaguucaccgugagccccagaaacagccccggcgaggugcugcuggaccuggagcugggccccgagaucaaccccuaccuggcccaccuggccagaauguacaacggcuacgccggcggcuucgaggugcagguggugcuggccggcaacgccuucaccgccggcaagaucaucuucgccgccaucccccccaacuuccccaucgacaaccugagcgccgcccagaucaccaugugcccccacgugaucguggacgugagacagcuggagcccgugaaccugcccaugcccgacgugagaaacaccuucuuccacuacaaccagggcagcgacagcagacugagacugaucgccaugcuguacaccccccugagagccaacaacagcggcgacgacguguucaccgugagcugcagagugcugaccagacccagccccgacuucagcuucaacuuccuggugccccccaccguggagagcaagaccaagcccuucacccugcccauccugaccaucagcgagaugagcaacagcagauuccccgugcccaucgacagccugcacaccagccccaccgagagcaucguggugcagugccagaacggcagagugacccuggacggcgagcugaugggcaccacccagcugcugcccagccagaucugcgccuucagaggcgugcugaccagaagcaccagcagagccagcgaccaggccgacaccgccacccccagacuguucaacuacuacuggcacauccagcuggacaaccugaacggcacccccuacgaccccgccgaggacauccccggcccccugggcacccccgacuucagaggcaagguguucggcguggccagccagagaaaccccgacagcaccaccagagcccacgaggccaagguggacaccaccaccggcagauucacccccaagcugggcagccuggagaucagcaccgagagcgacgacuucgaccagaaccagcccaccagauucacccccgugggcaucggcguggaccacgaggccgacuuccagcaguggagccugcccgacuacagcggccaguucacccacaacaugaaccuggcccccgccguggcccccaacuucagaggcgagcagcugcuguucuucagaagccagcugcccagcagcggcggcagaagcaacggcacccuggacugccuggugccccaggagugggugcagcacuucuaccaggagagcgcccccgcccagacccagguggcccuggugagauacgugaaccccgacaccggcagagugcuguucgaggccaagcugcacaagcugggcuucaugaccaucgccaagaacggcgacagccccaucaccgugccccccaacggcuacuucagauucgagagcugggugaaccccuucuacacccuggcccccaugggcaccggcaacggcagaagaagaauccaguga

SEQ ID NO: 23872 - RNA, 1644 nt, Artificial Sequence
  derived and/or modified sequence opt4 from capsid_protein__Norovirus__BAE92970
augaagauggccagcaacgacgccagccccagcaccgacggcagcgccggccuggugcccgaggugaacaacgagaccauggcccuggagcccguggugggcgccccccuggccgcccccguggccggccagcacaacaucaucgaccccuggaucaagaugaacuucgugcaggcccccaacggcgaguucaccgugagccccagaaacgcccccggcgagauccugcuggaccuggagcugggccccgaccugaaccccuaccugagccaccuggccagaauguacaacggcuacgccggcggcauggaggugcagguggugcuggccggcaacgccuucaccgccggcaagaucaucuucgccgccgugccccccaacuuccccgccgagaaccugagcgccgcccaggugaccaugugcccccacgugaucguggacgugagacagcuggagcccgugaugcugcccaugcccgacaucagaaacaagcuguuccacuacaaccagguggacgaccccaagcugagacugcuggccuaccuguacaccccccugagagccaacaacgccggcgacgacguguucaccgugagcugcagagugcugaccagacccacccccgacuucgaguucauguuccuggugccccccaccguggagagcaagaccaagcccuucagccugcccagccugacccuggacgagcugagcaacagcagauuccccgcccccaucgugcagcuguacaccaacccccacgacaaccugguggugcagccccagaacggcagaugcaccaucgacggccugcugcagggcaccacccagcuggugagcugcaacgugugcagcuucagaggcacccugggcgacggccagcccgccagccacagcgaggaggagaucaugcccauggccuucaacgugcagagagagaucaugcuggagaaccuggacggcagccccuacgaccccaccgacgacauccccgccgugcugggcagccccgacuuccagggcgugguguucggcauccugagccagagaaacaccgacggccagaccagagcccacgaggccaagguggacaccagagccgccagauucgcccccaagcugggcuucgugguggccaccguggagagcaccgacuuccacgccaaccagcccagcagauucacccccgugggccugggcggcgacggcaaccaggacuucaaccaguggagccugcccgccuacggcggcgcccugaccaacaacaccaaccuggccccccccgccaugcccguguaccccggcgagcagcugcuguucuucagaagccagcugcccagcagcggcggcguggugggcggcuggcuggacugccugcugccccaggagugggugcagcacuucuuccaggagagcgccaccagccagagcgacguggcccuggugagauacaucaaccccaccaccggcagagugcuguucgaggccaagcugcacaagcagggcuuccugaccguggccgccagcggcagcuacccccugguggugcccgccgacggcuacuucagauucgagagcugggugaaccaguucuacacccuggcccccaugggcaacggcagcggcagaagaagcgccagauga

SEQ ID NO: 23873 - RNA, 1623 nt, Artificial Sequence
  derived and/or modified sequence opt4 from capsid_protein__Norovirus__BAE98191
augaagauggccagcaacgacgccagccccagcgacggcagcaccgccaaccuggugcccgaggugaacaacgaggugauggcccuggagcccguggugggcgccgccaucgccgcccccguggccggccagcagaacgugaucgaccccuggaucagaaccaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugauccacauccccggcaccagaaccuacagaaugaaccuggccagccagaacuggaacaacuacgaccccaccgaggagauccccgccccccugggcacccccgacuucgugggcaagauccagggcaugcugacccagaccaccaagggcgacggcagcaccagaggccacaaggccaccgugagcaccggcagcguggacuucacccccaagcugggcagcgugcaguucgccaccgacaccgacaacgacuucgagaccggccagaacaccagauucacccccgugggcgugauccaggacggcagcagcgcccacagaaacgagccccagcagugggugcugcccgacuacagcggcagaaccgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccagccagagcgacguggcccugcugagauucgugaaccccgacaccggcagagugcuguucgagugcaagcugcacaaggccggcuacgugaccguggcccacaccggccagcacgaccuggugaucccccccaacggcuacuucagauucgacagcugggugaaccaguucuacacccuggcccccaugggcaacggcgccggcagaagaagagcccuguga

SEQ ID NO: 23874 - RNA, 1623 nt, Artificial Sequence
  derived and/or modified sequence opt4 from capsid_protein__Norovirus__BAE98194
augaagauggccagcaacgacgccagccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcaccagaaccuacagaaugaaccuggccagccagaacuggaacaacuacgaccccaccgaggagauccccgccccccugggcacccccgacuucgugggcaagauccagggcaugcugacccagaccaccaagggcgacggcagcaccagaggccacaaggccaccgugagcaccggcagcguggacuucacccccaagcugggcagcgugcaguucgccaccgacaccgacaacgacuucgagaccggccagaacaccagauucacccccgugggcgugauccaggacggcagcagcgcccacagaaacgagccccagcagugggugcugcccgacuacagcggcagaaccgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccagccagagcgacguggcccugcugagauucgugaaccccgacaccggcagagugcuguucgagugcaagcugcacaaggccggcuacgugaccguggcccacaccggccagcacgaccuggugaucccccccaacggcuacuucagauucgacagcugggugaaccaguucuacacccuggcccccaugggcaacggcgccggcagaagaagagcccuguga

SEQ ID NO: 23875 - RNA, 1623 nt, Artificial Sequence
  derived and/or modified sequence opt4 from capsid_protein__Norovirus__BAE98197
augaagauggccagcaacgacgccagccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcaccagaaccuacagaaugaaccuggccagccagaacuggaacaacuacgaccccaccgaggagauccccgccccccugggcacccccgacuucgugggcaagauccagggcaugcugacccagaccaccaagggcgacggcagcaccagaggccacaaggccaccgugagcaccggcagcguggacuucacccccaagcugggcagcgugcaguucgccaccgacaccgacaacgacuucgagaccggccagaacaccagauucacccccgugggcgugauccaggacggcagcagcacccacagaaacgagccccagcagugggugcugcccgacuacagcggcagaaccgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccagccagagcgacguggcccugcugagauucgugaaccccgacaccggcagagugcuguucgagugcaagcugcacaaggccggcuacgugaccguggcccacaccggccagcacgaccuggugaucccccccaacggcuacuucagauucgacagcugggugaaccaguucuacacccuggcccccaugggcaacggcgccggcagaagaagagcccuguga

SEQ ID NO: 23876 - RNA, 1623 nt, Artificial Sequence
  derived and/or modified sequence opt4 from capsid_protein__Norovirus__BAF45861
augaagauggccagcaacgacgccaaccccagcgacggcagcgccgccaaccuggugcccgaggugaacaacgaggugauggcccuggagcccguggugggcgccgccaucgccgcccccguggccggccagaccaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggccacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23877 - RNA, 1620 nt, Artificial Sequence
  derived and/or modified sequence opt4 from capsid_protein__Norovirus__BAF74508
augaagauggccagcaacgacgccacccccagcgacggcagcaccgccaaccuggugcccgaggugaacaacgaggugauggcccuggagcccguggugggcgccgccaucgccgcccccguggccggccagcagaacgugaucgaccccuggaucagaagcaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaccuucagaggcgacgugacccacaucgccggcagccacgacuacaccaugaaccuggccagccagaacuggaacaacuacgaccccaccgaggagauccccgccccccugggcacccccgacuucgugggcaagauccagggcgugcugacccagaccaccagaggcgacggcagcaccagagcccacaaggccaccgugagcaccggcagcgugcacuucacccccaagcugggcagcgugcaguacaccaccgacaccaacaacgacuuccagaccggccagaacaccaaguucacccccgugggcgugauccaggacggcgacaaccaccagaacgagccccagcagugggugcugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcgccggcagaagaagagcccuguga

SEQ ID NO: 23878 - RNA, 1620 nt, Artificial Sequence
  derived and/or modified sequence opt4 from capsid_protein__Norovirus__BAF74509
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaccuucagaggcgacgugacccacaucgccggcagccacgacuacaccaugaaccuggccagccagaacuggaacaacuacgaccccaccgaggagauccccgccccccugggcacccccgacuucgugggcaagauccagggcaugcugacccagaccaccagagaggacggcagcaccagagcccacaaggccaccgugagcaccggcagcgugcacuucacccccaagcugggcagcgugcaguacaccaccgacaccaacaacgacuuccagaccggccagaacaccaaguucacccccgugggcgugauccaggacggcaacaaccaccagaacgagccccagcagugggugcugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcgccggcagaagaagagcccuguga

SEQ ID NO: 23879 - RNA, 1620 nt, Artificial Sequence
  derived and/or modified sequence opt4 from capsid_protein__Norovirus__BAF74510
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccguguucugcagagugcugaccagacccagccccgacuucgacuucaucuuccuggugccccccaccguggagagcagaaccaagcccuucaccgugcccauccugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaccuucagaggcgacgugacccacaucgccggcagccacgacuacaccaugaaccuggccagccagaacuggaacaacuacgaccccaccgaggagauccccgccccccugggcacccccgacuucgugggcaagauccagggcaugcugacccagaccaccagagaggacggcagcaccagagcccacaaggccaccgugagcaccggcagcgugcacuucacccccaagcugggcagcgugcaguacaccaccgacaccaacaacgacuuccagaccggccagaacaccaaguucacccccgugggcgugauccaggacggcaacaaccaccagaacgagccccagcagugggugcugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcgccggcagaagaagagcccuguga

SEQ ID NO: 23880 - RNA, 1620 nt, Artificial Sequence
  derived and/or modified sequence opt4 from capsid_protein__Norovirus__BAF74511
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccaucccccuggagaagcuguucaccggccccagcagcgccuucguggugcagccccagaacggcagaugcaccaccgacggcgugcugcugggcaccacccagcugagcgccgugaacaucugcaccuucagaggcgacgugacccacaucgccggcagccacgacuacaccaugaaccuggccagccagaacuggaacaacuacgaccccaccgaggagauccccgccccccugggcacccccgacuucgugggcaagauccagggcaugcugacccagaccaccagagaggacggcagcaccagagcccacaaggccaccgugagcaccggcagcgugcacuucacccccaagcugggcagcgugcaguacaccaccgacaccaacaacgacuuccagaccggccagaacaccaaguucacccccgugggcgugauccaggacggcaacaaccaccagaacgagccccagcagugggugcugcccaacuacagcggcagaaccggccacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcuggaucaaccaguucuacacccuggcccccaugggcaacggcgccggcagaagaagagcccuguga

SEQ ID NO: 23881 - RNA, 1620 nt, Artificial Sequence
  derived and/or modified sequence opt4 from capsid_protein__Norovirus__BAF74512
augaagauggccagcaacgacgccacccccagcgacggcagcaccgccaaccuggugcccgaggugaacaacgaggugauggcccuggagcccguggugggcgccgccaucgccgccagaguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccgugccccuggagaagcuguacaccggccccagcagcgccuucguggugcagccccagaacggcagaugcaccaccgacggcgugcugcugggcaccacccagcugagcgccgugaacaucugcaccuucagaggcgacgugacccacaucgccggcagccacgacuacaccaugaaccuggccagccagaacuggaacaacuacgaccccaccgaggagauccccgccccccugggcacccccgacuucgugggcaagauccagggcgugcugacccagaccaccagagaggacggcagcaccagagcccacaaggccaccgugagcaccggcagcgugcacuucacccccaagcugggcagcgugcaguacaccaccgacaccaacaacgacuuccagaccggccagaacaccaaguucacccccgugggcgugauccaggacggcagcaaccaccagaacgagccccagcagugggugcugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcgccggcagaagcagcgcccuguga

SEQ ID NO: 23882 - RNA, 1620 nt, Artificial Sequence
  derived and/or modified sequence opt4 from capsid_protein__Norovirus__BAF74513
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaagcaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccgugccccuggagaagcuguacaccggccccagcagcgccuucguggugcagccccagaacggcagaugcaccaccgacggcgugcugcugggcaccacccagcugagcgccgugaacaucugcaccuucagaggcgacgugacccacaucgccggcagccacgacuacaccaugaaccuggccagccagaacuggaacaacuacgaccccaccgaggagauccccgccccccugggcacccccgacuucgugggcaagauccagggcgugcugacccagaccaccagagaggacggcagcaccagagcccacaaggccaccgugagcaccggcagcgugcacuucacccccaagcugggcagcgugcaguacaccaccgacaccaacaacgacuuccagaccggccagaacaccaaguucacccccgugggcgugauccaggacggcagcaaccaccagaacgagccccagcagugggugcugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcgccggcagaagaagagcccuguga

SEQ ID NO: 23883 - RNA, 1623 nt, Artificial Sequence
  derived and/or modified sequence opt4 from capsid_protein__Norovirus__BAF74514
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcacccugagaggcgacgugacccacaucgccggcacccacaacuacaccaugaaccuggccagccagaacuggaacaacuacgaccccaccgaggagauccccgccccccugggcacccccgacuucgugggcagaauccagggcgugcugacccagaccaccagaggcgacggcagcaccagaggccacaaggccaccgugagcaccggcgacgugcacuucacccccaagcugggcagcgugcaguucaacaccgacaccaacaacgacuucgagaucggccagaacaccagauucacccccgugggcguggugcaggacggcaacggcacccaccagaacgagccccagcagugggugcugcccagcuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23884 - RNA, 1620 nt, Artificial Sequence
  derived and/or modified sequence opt4 from capsid_protein__Norovirus__BAF74515
augaagauggccagcaacgacgccaaccccagcgacggcagcgccgccaaccuggugcccgaggugaacaacgaggugauggcccuggagcccguggugggcgccgccaucgccgcccccguggccggccagcagaacaucaucgaccccuggaucagaaacaacuucgugcaggcccccggcggcgaguucaccgugagccccagaaacgcccccggcgagauccuguggagcgccccccugggccccgaccugaaccccuaccugagccaccugagcagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccaggcccacgacagcacccugaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccgugcugaccguggaggagaugaccaacagcagauuccccaucccccuggagaagcuguacaccggccccagcagcgccaucguggugcagccccagaacggcagaugcaccaccgacggcgugcugcugggcaccacccagcugagcgccgugaacaucugcaccuucagaggcgacgugacccacaucgccggcagcagaaacuacaccaugaaccuggccagccagaacuggaacaacuacgaccccaccgaggagauccccgccccccugggcacccccgacuucgugggcaagauccagggccugcugacccagaccaccagagccgacggcagcaccagagcccacaaggccaccgugagcaccggcagcgugcacuucacccccaagcugggcagcgugcaguucagcaccgacaccgacaacgacuuccagcccggccagaacaccaaguucacccccgugggcgugauccaggacggcgacagacaccagaacgagccccagcagugggugcugcccgacuucagcggcagaaccggccacaacgugcaccuggcccccgccguggcccccaccuuccccggcgagcagcugcuguucuucagaagcaccaugcccggcagaagcggcuaccccaacaugaaccuggacugccugcugccccaggagugggugcugcacuucuaccaggagagcgcccccgcccagagcgacguggcccugcugagauucgugaaccccgacaccaacagagugcuguucgagugcaagcugcacaagagcggcuacaucaccguggcccacaccggccaccacgaccugauccugccccccaacggcuacuucagauucgacagcugggugaaccaguucuacacccuggcccccaugggcaacggcgccggcagaagaagagcccccuga

SEQ ID NO: 23885 - RNA, 1623 nt, Artificial Sequence
  derived and/or modified sequence opt4 from capsid_protein__Norovirus__BAF74516
augaagauggccagcaacgacgccacccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcagguggugcuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaaccuguaccacuacaaccagagcaacgaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccggcgaggagaugaccaacagcagauuccccaucccccuggagaagcuguucaccggccccagcggcgccuucguggugcagccccagaacggcagaugcaccaccgacggcgugcugcugggcaccacccagcugcugcccgugaacaucugcaccuucagaggcgacgugacccacaucgccggcacccacaacuacaccaugaaccuggccagccagaacuggaacaacuacgaccccaccgaggagauccccgccccccugggcacccccgacuucgugggcagaauccagggcaugcugacccagaccaccagaggcgacggcagcaccagaggccacaaggccaccgugagcaccggcgacgugcacuucacccccaagcugggcagcauccaguucaacaccgacaccaacaacgacuucgagaccggccagaacaccaaguucacccccgugggcguggugcaggacggcaacggcacccaccagaacgagccccagcagugggugcugcccagcuacagcggcagaaccagccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23886 - RNA, 1623 nt, Artificial Sequence
  derived and/or modified sequence opt4 from capsid_protein__Norovirus__BAF74517
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcacccacaacuacaccaugaaccuggccagccagaacuggaacaacuacgaccccaccgaggagauccccgccccccugggcacccccgacuucgugggcagaauccagggcaugcugacccagaccaccagaggcgacggcagcaccagaggccacaaggccaccgugagcaccggcgacgugcacuucacccccaagcugggcagcauccaguucaacaccgacaccaacaacgacuucgagaccggccagaacaccaaguucacccccgugggcguggugcaggacggcaacggcgcccaccagaacgagccccagcagugggugcugcccagcuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23887 - RNA, 1623 nt, Artificial Sequence
  derived and/or modified sequence opt4 from capsid_protein__Norovirus__BAF74518
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcacccacaacuacaccaugaaccuggccagccagaacuggaacaacuacgaccccaccgaggagauccccgccccccugggcacccccgacuucgugggcagaauccagggcaugcugacccagaccaccagaggcgacggcagcaccagaggccacaaggccaccgugagcaccggcgacgugcacuucacccccaagcugggcagcgugcaguucaacaccgacaccaacaacgacuucgagaccggccagaacaccagauucacccccgugggcguggugcaggacggcaacggcacccaccagaacgagccccagcagugggugcugcccagcuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23888 - RNA, 1623 nt, Artificial Sequence
  derived and/or modified sequence opt4 from capsid_protein__Norovirus__BAF74519
augaagauggccagcaacgacgccacccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcacccacaacuacaccaugaaccuggccagccagaacuggaacaacuacgaccccaccgaggagauccccgccccccugggcacccccgacuucgugggcagaauccagggcaugcugacccagaccaccagaggcgacggcagcaccagaggccacaaggccaccgugagcaccggcgacgugcacuucacccccaagcugggcagcauccaguucaacaccgacaccaacaacgacuucgagaccggccagaacaccaaguucacccccgugggcguggugcaggacggcaacggcacccaccagaacgagccccagcagugggugcugcccagcuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuaccugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23889 - RNA, 1623 nt, Artificial Sequence
  derived and/or modified sequence opt4 from capsid_protein__Norovirus__BAF74520
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcacccacaacuacaccaugaaccuggccagccagaacuggaacaacuacgaccccaccgaggagauccccgccccccugggcacccccgacuucgugggcagaauccagggcaugcugacccagaccaccagaggcgacggcagcaccagaggccacaaggccaccgugagcaccggcgacgugcacuucacccccaagcugggcagcauccaguucaacaccgacaccaacaacgacuucgagaccggccagaacaccaaguucacccccgugggcgugauccaggacggcaacggcgcccaccagaacgagccccagcagugggugcugcccagcuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacaucaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23890 - RNA, 1623 nt, Artificial Sequence
  derived and/or modified sequence opt4 from capsid_protein__Norovirus__BAF74521
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccagcuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcacccacaacuacaccaugaaccuggccagccagaacuggaacaacuacgaccccaccgaggagauccccgccccccugggcacccccgacuucgugggcagaauccagggcaugcugacccagaccaccagaggcgacggcagcaccagaggccacaaggccaccgugagcaccggcgacgugcacuucacccccaagcugggcagcauccaguucaacaccgacaccaacaacgacuucgagaccggccagaacaccaaguucacccccgugggcguggugcaggacggcaacggcacccaccagaacgagccccagcagugggugcugcccagcuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23891 - RNA, 1623 nt, Artificial Sequence
  derived and/or modified sequence opt4 from capsid_protein__Norovirus__BAF74522
augaagauggccagcaacgacgccacccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccagcuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcacccacaacuacaccaugaaccuggccagccagaacuggaacaacuacgaccccaccgaggagauccccgccccccugggcacccccgacuucgugggcagaauccagggcaugcugacccagaccaccagaggcgacggcagcaccagaggccacaaggccaccgugagcaccggcgacgugcacuucacccccaagcugggcagcgugcaguucgacaccgacaccaacagcgacuucgagaccggccagaacaccaaguucacccccgugggcguggugcaggacggcaacggcgcccaccagaacgagccccagcagugggugcugcccagcuacagcggcagaaccggccacaacgcccaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23892 - RNA, 1623 nt, Artificial Sequence; identical to SEQ ID NO: 22537
  derived and/or modified sequence opt4 from capsid_protein__Norovirus__BAF74523

SEQ ID NO: 23893 - RNA, 1623 nt, Artificial Sequence; identical to SEQ ID NO: 22537
  derived and/or modified sequence opt4 from capsid_protein__Norovirus__BAF74524

SEQ ID NO: 23894 - RNA, 1623 nt, Artificial Sequence; identical to SEQ ID NO: 22537
  derived and/or modified sequence opt4 from capsid_protein__Norovirus__BAF74525

SEQ ID NO: 23895 - RNA, 1623 nt, Artificial Sequence
  derived and/or modified sequence opt4 from capsid_protein__Norovirus__BAF74526
augaagauggccagcaacgacgccacccccagcgacggcagcaccgccaaccuggugcccgaggugaacaccgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagaaccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccagaacuacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcauccacuucacccccaagcugggcagcgugcaguucagcaccgacaccagcaacgacuucgagaccggccagaacaccagauucacccccgugggcguggugcaggacggcagcaccacccaccagaacgagccccagcagugggugcugcccgacuacagcggcagagacagccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggagagcgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagagcccuguga

SEQ ID NO: 23896 - RNA, 1623 nt, Artificial Sequence
  derived and/or modified sequence opt4 from capsid_protein__Norovirus__BAF74527
augaagauggccagcaacgacgccacccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccagaacuacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcauccacuucacccccaagcugggcagcgugcaguucagcaccgacaccagcaacgacuucgagaccggccagaacaccagauucacccccgugggcguggugcaggacggcagcaccacccaccagaacgagccccagcagugggugcugcccgacuacagcggcagagacagccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggagagcgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagagcccuguga

SEQ ID NO: 23897 - RNA, 1620 nt, Artificial Sequence
  derived and/or modified sequence opt4 from capsid_protein__Norovirus__BAF95499
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccgugccccuggagaagcuguacaccggccccagcagcgccuucguggugcagccccagaacggcagaugcaccaccgacggcgugcugcugggcaccacccagcugagcgccgugaacaucugcaccuucagaggcgacgugacccacaucgccggcagccacgacuacaccaugaaccuggccagccagaacuggaacaacuacgaccccaccgaggagauccccgccccccugggcacccccgacuucgugggcaagauccagggcgugcugacccagaccaccagagaggacggcagcaccagagcccacaaggccaccgugagcaccggcagcgugcacuucacccccaagcugggcagcgugcaguacaccaccgacaccaacaacgacuuccagaccggccagaacaccaaguucacccccgugggcgugauccaggacggcagcaaccaccagaacgagccccagcagugggugcugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcgccggcagaagaagagcccuguga

SEQ ID NO: 23898 - RNA, 1620 nt, Artificial Sequence
  derived and/or modified sequence opt4 from capsid_protein__Norovirus__BAF95501
augaagauggccagcaacgacgugaaccccagcgacggcagcgccgccaaccuggugcccgaggugaacaacgaggugauggcccuggagcccguggugggcgccgccaucgccgcccccguggccggccagcagaacaucaucgaccccuggaucagaaacaacuucgugcaggcccccggcggcgaguucaccgugagccccagaaacgcccccggcgagauccuguggagcgccccccugggccccgaccugaaccccuaccugagccaccugagcagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccaggcccacgacagcacccugaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccgugcugaccguggaggagaugaccaacagcagauuccccaucccccuggagaagcuguacaccggccccagcagcgccuucguggugcagccccagaacggcagaugcaccaccgacggcgugcugcugggcaccacccagcugagcgccgugaacaucugcaccuucagaggcgacgugacccacaucgccggcagcagaaacuacaccaugaaccuggccagccagaacuggaacaacuacgaccccaccgaggagauccccgccccccugggcacccccgacuucgugggcaagauccagggccugcugacccagaccaccagagccgacggcagcaccagagcccacaaggccaccgugagcaccggcagcgugcacuucacccccaagcugggcagcgugcaguucagcaccgacaccgacaacgacuuccagcccggccagaacaccaaguucacccccgugggcgugauccaggacggcgacagacaccagaacgagccccagcagugggugcugcccgacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcugcacuucuaccaggagagcgcccccgcccagagcgacguggcccugcugagauucgugaaccccgacaccaacagagugcuguucgagugcaagcugcacaagagcggcuacaucaccguggcccacaccggccagcacgaccugauccugccccccaacggcuacuucagauucgacagcugggugaaccaguucuacacccuggcccccaugggcaacggcgccggcagaagaagagcccccuga

SEQ ID NO: 23899 - RNA, 1623 nt, Artificial Sequence
  derived and/or modified sequence opt4 from capsid_protein__Norovirus__BAF95503
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcacccacaacuacaccaugaaccuggccagccagaacuggaacaacuacgaccccaccgaggagauccccgccccccugggcacccccgacuucgugggcagaauccagggcaugcugacccagaccaccaagggcgacggcagcaccagaggccacaaggccaccgugagcaccggcgacgugcacuucacccccaagcugggcagcauccaguucaacaccgacaccaacaacgacuucgagaccggccagaacaccaaguucacccccgugggcguggugcaggacggcaacggcacccaccagaacgagccccagcagugggugcugcccagcuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23900 - RNA, 1623 nt, Artificial Sequence
  derived and/or modified sequence opt4 from capsid_protein__Norovirus__BAF95505
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccgugcugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcacccacaacuacaccaugaaccuggccagccagaacuggaacaacuacgaccccaccgaggagauccccgccccccugggcacccccgacuucgugggcagaauccagggcaugcugacccagaccaccaagggcgacggcagcaccagaggccacaaggccaccgugagcaccggcgacgugcacuucacccccaagcugggcagcauccaguucaacaccgacaccaacaacgacuucgagaccggccagaacaccaaguucacccccgugggcguggugcaggacggcaacggcacccaccagaacgagccccagcagugggugcugcccagcuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23901 - RNA, 1623 nt, Artificial Sequence; identical to SEQ ID NO: 23874
  derived and/or modified sequence opt4 from capsid_protein__Norovirus__BAF95507

SEQ ID NO: 23902 - RNA, 1623 nt, Artificial Sequence
  derived and/or modified sequence opt4 from capsid_protein__Norovirus__BAF95509
augaagauggccagcaacgacgccacccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccagaacuacaccaugaaccuggccagccagaacuggaacaacuacgaccccaccgaggagauccccgccccccugggcacccccgacuucgugggcaagauccagggcgugcugacccagaccaccagaggcgacggcagcaccagaggccacaaggccaccgugagcaccggcagcgugcacuucacccccaagcugggcagcgugcaguucagcaccgacaccagcaacgacuucgagaccggccagaacaccagauucacccccgugggcguggugcaggacggcagcaccacccaccagaacgagccccagcagugggugcugcccaacuacagcggcagagacagccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggagagcgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagagcccuguga

SEQ ID NO: 23903 - RNA, 1623 nt, Artificial Sequence; identical to SEQ ID NO: 22559
  derived and/or modified sequence opt4 from capsid_protein__Norovirus__BAF95511

SEQ ID NO: 23904 - RNA, 1623 nt, Artificial Sequence
  derived and/or modified sequence opt4 from capsid_protein__Norovirus__BAF95513
augaagauggccagcaacgacgccacccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccagaacuacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcgugcacuucacccccaagcugggcagcgugcaguucagcaccgacaccagcaacgacuucgagaccggccagaacaccagauucacccccgugggcguggugcaggacggcagcaccacccaccagaacgagccccagcagugggugcugcccaacuacagcggcagagacagccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggagagcgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagagcccuguga

SEQ ID NO: 23905 - RNA, 1623 nt, Artificial Sequence; identical to SEQ ID NO: 22385
  derived and/or modified sequence opt4 from capsid_protein__Norovirus__BAF95515

SEQ ID NO: 23906 - RNA, 1623 nt, Artificial Sequence
  derived and/or modified sequence opt4 from capsid_protein__Norovirus__BAF95517
augaagauggccagcaacgacgccagccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcaccagaaccuacagaaugaaccuggccagccagaacuggaacaacuacgaccccaccgaggagauccccgccccccugggcacccccgacuucgugggcaagauccagggcaugcugacccagaccaccaagggcgacggcagcaccagaggccacaaggccaccgugagcaccggcagcguggacuucacccccaagcugggcagcgugcaguucgccaccgacaccgacaacgacuucgagaccggccagaacaccagauucacccccgugggcgugauccaggacggcagcagcgcccacagaaacgagccccagcagugggugcugcccgacuacagcggcagaaccgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccagccagagcgacguggcccugcugagauucgugaaccccgacaccggcagagugcuguucgagugcaagcugcacaaggccggcuacgugaccguggcccacaccggccagcacgaccuggugaucccccccaacggcuacuucagauucgacagcugggugaaccaguucuacacccuggcccccaugggcaacggcgccggcagaagaagagcccuguga

SEQ ID NO: 23907 - RNA, 1623 nt, Artificial Sequence
  derived and/or modified sequence opt4 from capsid_protein__Norovirus__BAF95519
augaagauggccagcaacgacgccacccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccagaacuacaccaugaaccuggccagccagaacuggaacaacuacgaccccaccgaggagauccccgccccccugggcacccccgacuucgugggcaagauccagggcgugcugacccagaccaccaccagagacggcagcaccagaggccacaaggccaccgugagcaccggcagcgugcacuucacccccaagcugggcagcgugcaguucagcaccgacaccagcaacgacuucgagaccggccagaacaccagauucacccccgugggcguggugcaggacggcagcaccacccaccagaacgagccccagcagugggugcugcccgacuacagcggcagagacagccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggagagcgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagagcccuguga

SEQ ID NO: 23908 - RNA, 1623 nt, Artificial Sequence
  derived and/or modified sequence opt4 from capsid_protein__Norovirus__BAF95521
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacagcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccaggaguacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcgugcacuucacccccaagcugggcagaauccaguucagcaccgacaccagcaacgacuucgagaccggccagaacaccagauucacccccgugggcguggugcaggacggcggcaccacccaccagaacgagccccagcagugggugcugcccaacuacagcggcagagacagccacaacgugcaccuggcccccgccguggcccccagcuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23909 - RNA, 1623 nt, Artificial Sequence; identical to SEQ ID NO: 23085
  derived and/or modified sequence opt4 from capsid_protein__Norovirus__BAF95523

SEQ ID NO: 23910 - RNA, 1623 nt, Artificial Sequence; identical to SEQ ID NO: 22385
  derived and/or modified sequence opt4 from capsid_protein__Norovirus__BAF95525

SEQ ID NO: 23911 - RNA, 1623 nt, Artificial Sequence
  derived and/or modified sequence opt4 from capsid_protein__Norovirus__BAF95527
augaagauggccagcaacgacgccagccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgacgugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcaccagaaccuacagaaugaaccuggccagccagaacuggaacaacuacgaccccaccgaggagauccccgccccccugggcacccccgacuucgugggcaagauccagggcaugcugacccagaccaccaagggcgacggcagcaccagaggccacaaggccaccgugagcaccggcagcguggacuucacccccaagcugggcagcgugcaguucgccaccgacaccgacaacgacuucgagaccggccagaacaccagauucacccccgugggcgugauccaggacggcagcagcacccacagaaacgagccccagcagugggugcugcccgacuacagcggcagaaccgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccagccagagcgacguggcccugcugagauucgugaaccccgacaccggcagagugcuguucgagugcaagcugcacaaggccggcuacgugaccguggcccacaccggccagcacgaccuggugaucccccccaacggcuacuucagauucgacagcugggugaaccaguucuacacccuggcccccaugggcaacggcgccggcagaagaagagcccuguga

SEQ ID NO: 23912 - RNA, 1623 nt, Artificial Sequence
  derived and/or modified sequence opt4 from capsid_protein__Norovirus__BAF95529
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcaugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23913 - RNA, 1623 nt, Artificial Sequence; identical to SEQ ID NO: 22522
  derived and/or modified sequence opt4 from capsid_protein__Norovirus__BAF95531

SEQ ID NO: 23914 - RNA, 1623 nt, Artificial Sequence; identical to SEQ ID NO: 23226
  derived and/or modified sequence opt4 from capsid_protein__Norovirus__BAG30923

SEQ ID NO: 23915 - RNA, 1629 nt, Artificial Sequence
  derived and/or modified sequence opt4 from capsid_protein__Norovirus__BAG34630
augaagauggccagcaacgacgccgcccccagcaccgacggcgccgccggccuggugcccgagagcaacaacgaggugauggcccuggagcccguggccggcgccgcccuggccgcccccgugaccggccagaccaacaucaucgaccccuggaucagagccaacuucgugcaggcccccaacggcgaguucaccgugagccccagaaacgcccccggcgaggugcugcugaaccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccguggagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauuccccgugagcaucgaccagauguacaccagccccaacgaggugaucagcgugcagugccagaacggcagaugcacccuggacggcgagcugcagggcaccacccagcugcaggugagcggcaucugcgccuucaagggcgaggugaccgcccaccugcacgacaacgaccaccuguacaacgugaccaucaccaaccugaacggcagccccuucgaccccagcgaggacauccccgccccccugggcgugcccgacuuccagggcagaguguucggcgugaucagccagagagacaagcagaacgccgccggccacaacgagcccgccaacagaggccacgacgccguggugcccaccuacaccgcccaguacacccccaagcugggccagauccagaucggcaccuggcagaccgacgaccugaccgugaaccagcccgugaaguucacccccgugggccugaacgacaccgagcacuucaaccaguggguggugcccagauacgccggcgcccugaaccugaacaccaaccuggcccccagcguggcccccguguuccccggcgagagacugcuguucuucagaagcuacaucccccugaagggcggcuacggcaaccccgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagagugcaguga

SEQ ID NO: 23916 - RNA, 1629 nt, Artificial Sequence
  derived and/or modified sequence opt4 from capsid_protein__Norovirus__BAG34632
augaagauggccagcaacgacgccgcccccagcaccgacggcgccgccggccuggugcccgagagcaacaacgaggugauggcccuggagcccguggccggcgccgcccuggccgcccccgugaccggccagaccaacaucaucgaccccuggaucagagccaacuucgugcaggcccccaacggcgaguucaccgugagccccagaaacgcccccggcgaggugcugcugaaccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccguggagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauuccccgugagcaucgaccagauguucaccagccccaacgaggugaucagcgugcagugccagaacggcagaugcacccuggacggcgagcugcagggcaccacccagcugcaggugagcggcaucugcguguucaagggcgaggugaccgcccaccugcacgacaacgaccaccuguacaacaucaccaucaccaaccugaacggcagccccuucgaccccagcgaggacgugcccgccccccugggcgugcccgacuuccagggcagaguguucggcgugaucagccagagagacaaccacaacgccagcggccacaaccagcccgccaacagaggccacgacgccguggugcccaccuacaccgcccaguacacccccaagcugggccagauccagaucggcaccuggcagaccgacgaccugaccgugaaccagcccgugaaguucacccccgugggccugaacgacguggagcacuucaaccaguggguggugcccagauacgccggcgcccugaaccugaacaccaaccuggcccccagcguggcccccguguuccccggcgagagacugcuguucuucagaagcuaccugccccugaagggcggcuacggcaaccccgugaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagaauccaguga

SEQ ID NO: 23917 - RNA, 1629 nt, Artificial Sequence
  derived and/or modified sequence opt4 from capsid_protein__Norovirus__BAG34634
augaagauggccagcaacgacgccgcccccagcaccgacggcgccgccggccuggugcccgagagcaacaacgaggugauggcccuggagcccguggccggcgccgcccuggccgcccccgugaccggccagaccaacaucaucgaccccuggaucagagccaacuucgugcaggcccccaacggcgaguucaccgugagccccagaaacgcccccggcgaggugcugcugagccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccguggagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauuccccgugagcaucgaccagauguacaccagccccaacgaggugaucagcgugcagugccagaacggcagaugcacccuggacggcgagcugcagggcaccacccagcugcaggugagcggcaucugcgccuucaagggcgaggugaccgcccaccugcacgacaacgaccaccuguacaacgugaccaucaccaaccugaacggcagccccuucgaccccagcgaggacauccccgccccccugggcgugcccgacuuccagggcagaguguucggcgugaucagccagagagacaagcacaacgccagcggccacaacgagcccgccaacagaggccacgacgccguggugcccaccuacaccgcccaguacacccccaagcugggccagauccagaucggcaccuggcagaccgacgaccugaccgugaaccagcccgugaaguucacccccgugggccugaacgacaccgagcacuucaaccaguggguggugcccagauacgccggcgcccugaaccugaacaccaaccuggcccccagcguggcccccguguuccccggcgagagacugcuguucuucagaagcuacaucccccugaagggcggcuacggcaaccccgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagagugcaguga

SEQ ID NO: 23918 - RNA, 1629 nt, Artificial Sequence
  derived and/or modified sequence opt4 from capsid_protein__Norovirus__BAG34636
augaagauggccagcaacgacgccgcccccagcaccgacggcgccgccggccuggugcccgagagcaacaacgaggugauggcccuggagcccguggccggcgccgcccuggccgcccccgugaccggccagaccaacaucaucgaccccuggaucagagccaacuucgugcaggcccccaacggcgaguucaccgugagccccagaaacgcccccggcgaggugcugcugaaccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccguggagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauuccccgugagcaucgaccagauguucaccagccccaacgaggugaucagcgugcagugccagaacggcagaugcacccuggacggcgagcugcagggcagcacccagcugcaggugagcggcaucugcgccuucaagggcgaggugaccgcccaccugcacgacaacgaccaccuguacaacaucaccaucaccaaccugaacggcagccccuucgaccccagcgaggacgugcccgccccccugggcgugcccgacuuccagggcagaguguucggcgugaucagccagagagacaaccacaacgccagcggccacaaccagcccgccaacagaggccacgacgccguggugcccaccuacaccagccaguacacccccaagcugggccagauccagaucggcaccuggcagaccgacgaccugaccgugaaccagcccgugaaguucacccccgugggccugaacgacguggagcacuucaaccaguggguggugcccagauacgccggcgcccugaaccugaacaccaaccuggcccccagcguggcccccguguuccccggcgagagacugcuguucuucagaagcuaccugccccugaagggcggcuacggcaaccccgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagaauccaguga

SEQ ID NO: 23919 - RNA, 1629 nt, Artificial Sequence; identical to SEQ ID NO: 22458
  derived and/or modified sequence opt4 from capsid_protein__Norovirus__BAG34638

SEQ ID NO: 23920 - RNA, 1629 nt, Artificial Sequence; identical to SEQ ID NO: 22458
  derived and/or modified sequence opt4 from capsid_protein__Norovirus__BAG34640

SEQ ID NO: 23921 - RNA, 1629 nt, Artificial Sequence; identical to SEQ ID NO: 22458
  derived and/or modified sequence opt4 from capsid_protein__Norovirus__BAG34642

SEQ ID NO: 23922 - RNA, 1629 nt, Artificial Sequence; identical to SEQ ID NO: 22458
  derived and/or modified sequence opt4 from capsid_protein__Norovirus__BAG34644

SEQ ID NO: 23923 - RNA, 1629 nt, Artificial Sequence; identical to SEQ ID NO: 22458
  derived and/or modified sequence opt4 from capsid_protein__Norovirus__BAG34646

SEQ ID NO: 23924 - RNA, 1629 nt, Artificial Sequence
  derived and/or modified sequence opt4 from capsid_protein__Norovirus__BAG34648
augaagauggccagcaacgacgccgcccccagcaccgacggcgccgccggccuggugcccgagagcaacaacgaggugauggcccuggagcccguggccggcgccgcccuggccgcccccgugaccggccagaccaacaucaucgaccccuggaucagagccaacuucgugcaggcccccaacggcgaguucaccgugagccccagaaacgcccccggcgaggugcugcugagccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccguggagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauuccccgugagcaucgaccagauguacaccagccccaacgaggugaucagcgugcagugccagaacggcagaugcacccuggacggcgagcugcagggcagcacccagcugcaggugagcggcaucugcgccuucaagggcgaggugaccgcccaccugcacgacaacgaccaccuguacaacgugaccaucaccaaccugaacggcagccccuucgaccccagcgaggacauccccgccccccugggcgugcccgacuuccagggcagaguguucggcgugaucagccagagagacaagcacaacagccccggccacaacgagcccgccaacagaggccacgacgccguggugcccaccuacaccagccaguacacccccaagcugggccagauccagaucggcaccuggcagaccgacgaccugaccgugaaccagcccgugaaguucacccccgugggccugaacgacaccgagcacuucaaccaguggguggugcccagauacgccggcgcccugaaccugaacaccaaccuggcccccagcguggcccccguguuccccggcgagagacugcuguucuucagaagcuacaucccccugaagggcggcuacggcaaccccgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagagugcaguga

SEQ ID NO: 23925 - RNA, 1629 nt, Artificial Sequence; identical to SEQ ID NO: 22458
  derived and/or modified sequence opt4 from capsid_protein__Norovirus__BAG34650

SEQ ID NO: 23926 - RNA, 1629 nt, Artificial Sequence
  derived and/or modified sequence opt4 from capsid_protein__Norovirus__BAG34652
augaagauggccagcaacgacgccgcccccagcaccgacggcgccgccggccuggugcccgagagcaacaacgaggugauggcccuggagcccguggccggcgccgcccuggccgcccccgugaccggccagaccaacaucaucgaccccuggaucagagccaacuucgugcaggcccccaacggcgaguucaccgugagccccagaaacgcccccggcgaggugcugcugaaccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccguggagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauuccccgugagcaucgaccagauguacaccagccccaacgaggugaucagcgugcagugccagaacggcagaugcacccuggacggcgagcugcagggcaccacccagcugcaggugagcggcaucugcgccuucaagggcgaggugaccgcccaccugcacgacaacgaccaccuguacaacgugaccaucaccaaccugaacggcagccccuucgaccccagcgaggacauccccgccccccugggcgugcccgacuuccagggcagaguguucggcgugaucagccagagagacaagcacaacagccccggccacaacgagcccgccaacagaggccacgacgccguggugcccaccuacaccccccaguacacccccaagcugggccagauccagaucggcaccuggcagaccgacgaccugaccgugaaccagcccgugaaguucacccccgugggccugaacgacaccgagcacuucaaccaguggguggugcccagauacgccggcgcccugaaccugaacaccaaccuggcccccagcguggcccccguguuccccggcgagagacugcuguucuucagaagcuacaucccccugaagggcggcuacggcaaccccgccaucgacugccugcugccccaggagugggugcagcacuucuaccaggaggccgcccccagcaucagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagagugcaguga

SEQ ID NO: 23927 - RNA, 1629 nt, Artificial Sequence
  derived and/or modified sequence opt4 from capsid_protein__Norovirus__BAG34654
augaagauggccagcaacgacgccgcccccagcaccgacggcgccgccggccuggugcccgagagcaacaacgaggugauggcccuggagcccguggccggcgccgcccuggccgcccccgugaccggccagaccaacaucaucgaccccuggaucagagccaacuucgugcaggcccccaacggcgaguucaccgugagccccagaaacgcccccggcgaggugcugcugaaccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccguggagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauuccccgugagcaucgaccagauguacaccagccccaacgaggugaucagcgugcagugccagaacggcagaugcacccuggacggcgagcugcagggcaccacccagcugcaggugagcggcaucugcgccuucaagggcgaggugaccgcccaccugcacgacaacgaccaccuguacaacgugaccaucaccaaccugaacggcagccccuucgaccccagcgaggacauccccgccccccugggcgugcccgacuuccagggcagaguguucggcgugaucagccagagagacaagcacaacagccccggccacaacgagagcgccaacagaggccacgacgccguggugcccaccuacaccagccaguacacccccaagcugggccagauccagaucggcaccuggcagaccgacgaccugaccgugaaccagcccgugaaguucacccccgugggccugaacgacaccgagcacuucaaccaguggguggugcccagauacgccggcgcccugaaccugaacaccaaccuggcccccagcguggcccccguguuccccggcgagagacugcuguucuucagaagcuacaucccccugaagggcggcuacggcaaccccgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagagugcaguga

SEQ ID NO: 23928 - RNA, 1629 nt, Artificial Sequence
  derived and/or modified sequence opt4 from capsid_protein__Norovirus__BAG34656
augaagauggccagcaacgacgccgcccccagcaccgacggcgccgccggccuggugcccgagagcaacaacgaggugauggcccuggagcccguggccggcgccgcccuggccgcccccgugaccggccagaccaacaucaucgaccccuggaucagagccaacuucgugcaggcccccaacggcgaguucaccgugagccccagaaacgcccccggcgaggugcugcugaaccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccguggagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauuccccgugagcaucgaccagauguacaccagccccaacgaggugaucagcgugcagugccagaacggcagaugcacccuggacggcgagcugcagggcaccacccagcugcaggugagcggcaucugcgccuucaagggcgaggugaccgcccaccugcacgacaacgaccaccuguacaacgugaccaucaccaaccugaacggcagccccuucgaccccagcgaggacauccccgccccccugggcgugcccgacuuccagggcagaguguucggcgugaucagccagagagacaagcacaacagccccggccacaacgagcccgccaacagaggccacgacgccguggugcccaccuacaccagccaguacacccccaagcugggccagauccagaucggcaccuggcagaccgacgaccugaucgugaaccagcccgugaaguucacccccgugggccugaacgacaccgagcacuucaaccaguggguggugcccagauacgccggcgcccugaaccugaacaccaaccuggcccccagcguggcccccguguuccccggcgagagacugcuguucuucagaagcuacaucccccugaagggcggcuacggcaaccccgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagagugcaguga

SEQ ID NO: 23929 - RNA, 1629 nt, Artificial Sequence; identical to SEQ ID NO: 22458
  derived and/or modified sequence opt4 from capsid_protein__Norovirus__BAG34658

SEQ ID NO: 23930 - RNA, 1629 nt, Artificial Sequence
  derived and/or modified sequence opt4 from capsid_protein__Norovirus__BAG34662
augaagauggccagcaacgacgccgcccccagcaccgacggcgccgccggccuggugcccgagagcaacagcgaggugauggcccuggagcccguggccggcgccgcccuggccgcccccgugaccggccagaccaacaucaucgaccccuggaucagaagcaacuucgugcaggcccccaacggcgaguucaccgugagccccagaaacgcccccggcgaggugcugcugaaccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccguggagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauuccccgugagcaucgaccagauguacaccagccccaacgaggugaucagcgugcagugccagaacggcagaugcacccuggacggcgagcugcagggcaccacccagcugcaggugagcggcaucugcgccuucaagggcgaggugaccgcccaccugcagaacgacgaccaccuguacaacaucaccaucaccaaccugaacggcagccccuucgaccccagcgaggacauccccgccccccugggcgugcccgacuuccagggcagaguguucggcgugaucacccagagagacaagcagaacgccaccggccagaaccagcccgccaacagaggccacgacgccguggugcccaccuacaccgcccaguacacccccaagcugggccagauccagaucggcaccuggcagaccgacgaccugaaggugaaccagcccgugaaguucacccccgugggccugaacgacaccgagcacuucaaccaguggguggugcccagauacgccggcgcccugaaccugaacaccaaccuggcccccagcguggcccccguguuccccggcgagagacugcuguucuucagaagcuaccugccccugaagggcggcuacggcaaccccgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagaauccaguga

SEQ ID NO: 23931 - RNA, 1629 nt, Artificial Sequence
  derived and/or modified sequence opt4 from capsid_protein__Norovirus__BAG34664
augaagauggccagcaacgacgccgcccccagcaccgacggcgccgccggccuggugcccgagagcaacaacgaggugauggcccuggagcccguggccggcgccgcccuggccgcccccgugaccggccagaccaacaucaucgaccccuggaucagagccaacuucgugcaggcccccaacggcgaguucaccgugagccccagaaacgcccccggcgaggugcugcugaaccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccguggagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauuccccgugagcaucgaccagauguacaccagccccaacgaggugaucagcgugcagugccagaacggcagaugcacccuggacggcgagcugcagggcaccacccagcugcaggugagcggcaucugcgccuucaagggcgaggugaccgcccaccugcacgacaacgaccaccuguacaacaucaccaucaccaaccugaacggcagccccuucgaccccagcgaggacacccccgccccccugggcgugcccgacuuccagggcagaguguucggcaucaucagccagagagacaagcagaacgccaccggccacaacgagcccgccaacagaggccacgacgccguggugcccaccuacaccgcccaguacacccccaagcugggccagauccagaucggcaccuggcagaccgacgaccugaccgugaaccagcccgugaaguucacccccgugggccugaacgacaccgagcacuucaaccaguggguggugcccagauacgccggcgcccugaaccugaacaccaaccuggcccccagcguggcccccguguuccccggcgagagacugcuguucuucagaagcuacaucccccugaagggcggcuacggcaaccccgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagagugcaguga

SEQ ID NO: 23932 - RNA, 1629 nt, Artificial Sequence; identical to SEQ ID NO: 22458
  derived and/or modified sequence opt4 from capsid_protein__Norovirus__BAG34666

SEQ ID NO: 23933 - RNA, 1629 nt, Artificial Sequence
  derived and/or modified sequence opt4 from capsid_protein__Norovirus__BAG34668
augaagauggccagcaacgacgccgcccccagcaccgacggcgccgccggccuggugcccgagagcaacaacgaggugauggcccuggagcccguggccggcgccgcccuggccgcccccgugaccggccagaccaacaucaucgaccccuggaucagagccaacuucgugcaggcccccaacggcgaguucaccgugagccccagaaacgcccccggcgaggugcugcugaaccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccguggagaaccugagcccccagcagaucaccauguucccccacgugaucaucgacgugagaauccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauuccccgugagcaucgaccagauguacaccagccccaacgaggugaucagcgugcagugccagaacggcagaugcacccuggacggcgagcugcagggcaccacccagcugcaggugagcggcaucugcgccuucaagggcgaggugaccgcccaccugcacgacaacgaccaccuguacaacgugaccaucaccaaccugaacggcagccccuucgaccccagcgaggacauccccgccccccugggcgugcccgacuuccagggcagaguguucggcgugaucagccagagagacaagcacaacagccccggccacaacgagcccgccaacagaggccacgacgccguggugcccaccuacaccagccaguacacccccaagcugggccagauccagaucggcaccuggcagaccgacgaccugaccgugaaccagcccgugaaguucacccccgugggccugaacgacaccgagcacuucaaccaguggguggugcccagauacgccggcgcccugaaccugaacaccaaccuggcccccagcguggcccccguguuccccggcgagagacugcuguucuucagaagcuacaucccccugaagggcggcuacggcaaccccgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagagugcaguga

SEQ ID NO: 23934 - RNA, 1629 nt, Artificial Sequence
  derived and/or modified sequence opt4 from capsid_protein__Norovirus__BAG34670
augaagauggccagcaacgacgccgcccccagcaccgacggcgccgccggccuggugcccgagagcaacaacgaggugauggcccuggagcccguggccggcgccgcccuggccgcccccgugaccggccagaccaacaucaucgaccccuggaucagagccaacuucgugcaggcccccaacggcgaguucaccgugagccccagaaacgcccccggcgaggugcugcugagccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccguggagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauuccccgugagcaucgaccagauguacaccagccccaacgaggugaucagcgugcagugccagaacggcagaugcacccuggacggcgagcugcagggcagcacccagcugcaggugagcggcaucugcgccuucaagggcgaggugaccgcccaccugcacgacaacgaccaccuguacaacgugaccaucaccaaccugaacggcagccccuucgaccccagcgaggacauccccgccccccugggcgugcccgacuuccagggcagaguguucggcgugaucagccagagagacaagcacaacagccccggccacaacgagcccgccaacagaggccacgacgccguggugcccaccuacaccagccaguacacccccaagcugggccagauccagaucggcaccuggcagaccgacgaccugaccgugaaccagcccgccaaguucacccccgugggccugaacgacaccgagcacuucaaccaguggguggugcccagauacgccggcgcccugaaccugaacaccaaccuggcccccagcguggcccccguguuccccggcgagagacugcuguucuucagaagcuacaucccccugaagggcggcuacggcaaccccgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagagugcaguga

SEQ ID NO: 23935 - RNA, 1623 nt, Artificial Sequence
  derived and/or modified sequence opt4 from capsid_protein__Norovirus__BAG55289
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccacccagaacuggaacagcuacgaccccaccgaggagauccccgccccccugggcacccccgacuucgugggcaagauccagggcgugcugacccagaccaccagagccgacggcagcaccagaggccacaaggccaccguguacaccggcagcgccgacuucgcccccaagcugggcagagugcaguucgccaccgacaccgacaacgacuucgacgccaaccagaacaccaaguucacccccgugggcgugauccaggacggcgacaccgcccacagaaacgagccccagcagugggugcugcccagcuacagcggcagaaacaaccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23936 - RNA, 1629 nt, Artificial Sequence
  derived and/or modified sequence opt4 from capsid_protein__Norovirus__BAG68707
augaagauggccagcaacgacgccgcccccagcaccgacggcgccgccggccuggugcccgagagcaacaacgaggugauggcccuggagcccguggccggcgccgcccuggccgcccccgugaccggccagaccaacaucaucgaccccuggaucagagccaacuucgugcaggcccccaacggcgaguucaccgugagccccagaaacgcccccggcgaggugcugcugaaccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccguggagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauuccccgugagcaucgaccagauguacaccagccccaacgaggugaucagcgugcagugccagaacggcagaugcacccuggacggcgagcugcagggcaccacccagcugcaggugagcggcaucugcgccuucaagggcgaggugaccgcccaccugcacgacaacgaccaccuguacaacaucaccaucaccaaccugaacggcagccccuucgaccccagcgaggacauccccgccccccugggcgugcccgacuuccagggcagaguguucggcaucaucagccagagagacaagcagaacgccaccggccacaacgagcccgccaacagaggccacgacgugguggugcccaccuacaccgcccaguacacccccaagcugggccagauccagaucggcaccuggcagaccgacgaccugaccgugaaccagcccgccaaguucacccccgugggccugaacgacaccgagcacuucaaccaguggguggugcccagauacgccggcgcccugaaccugaacaccaaccuggcccccagcguggcccccguguuccccggcgagagacugcuguucuucagaagcuacaucccccugaagggcggcuacggcaaccccgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagagugcaguga

SEQ ID NO: 23937 - RNA, 1629 nt, Artificial Sequence
  derived and/or modified sequence opt4 from capsid_protein__Norovirus__BAG68708
augaagauggccagcaacgacgccgcccccagcaccgacggcgccgccggccuggugcccgagagcaacaacgaggugauggcccuggagcccguggccggcgccgcccuggccgcccccgugaccggccagaccaacaucaucgaccccuggaucagagccaacuucgugcaggcccccaacggcgaguucaccgugagccccagaaacgcccccggcgaggugcugcugaaccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccguggagaaccugagcccccagcagaucaccauguucccccacgugaucaucgacgugagaacccuggagcccgugcugcugccccugcccgacgugagaaacaacuucuuccacuacaaccagaaggacgacagcaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauuccccgugagcaucgaccagauguacaccagccccaacgaggugaucagcgugcagugccagaacggcagaugcacccuggacggcgagcugcagggcaccacccagcugcaggugagcggcaucugcgccuucaagggcgaggugaccgcccaccugcacgacaacgaccaccuguacaacaucaccaucaccaaccugaacggcagccccuucgaccccagcgaggacauccccgccccccugggcgugcccgacuuccagggcagaguguucggcaucaucagccagagagacaagcagaacgccaccggccacagcgagcccgccaacagaggccacgacgccguggugcccaccuacaccgcccaguacacccccaagcugggccagauccagaucggcaccuggcagaccgacgaccugaccgugaaccagcccgugaaguucacccccgugggccugaacgacaccgagcacuucaaccaguggguggugcccagauacgccggcgcccugaaccugaacaccaaccuggcccccagcguggcccccguguuccccggcgagagacugcuguucuucagaagcuacaucccccugaagggcggcuacggcaaccccgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggcccccgccaacggcuacuucagauucgacagcugggugaaccaguucuacagccuggcccccaugggcaccggcaacggcagaagaagagugcaguga

SEQ ID NO: 23938 - RNA, 1629 nt, Artificial Sequence
  derived and/or modified sequence opt4 from capsid_protein__Norovirus__BAG68709
augaagauggccagcaacgacgccgcccccagcaccgacggcgccgccggccuggugcccgagagcaacaacgaggugauggcccuggagcccguggccggcgccgcccuggccgcccccgugaccggccagaccaacaucaucgaccccuggaucagagccaacuucgugcaggcccccaacggcgaguucaccgugagccccagaaacgcccccggcgaggugcugcugaaccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccguggagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauuccccgugagcaucgaccagauguacaccagccccaacgaggugaucagcgugcagugccagaacggcagaugcacccuggacggcgagcugcagggcaccacccagcugcaggugagcggcaucugcgccuucaagggcgaggugaccgcccaccugcacgacaacgaccaccuguacaacaucaccaucaccaaccugaacggcagccccuucgaccccagcgaggacauccccgccccccugggcgugcccgacuuccagggcagaguguucggcaucaucagccagagagacaagcagaacgccaccggccacaacgagcccgccaacagaggccacgacgccguggugcccaccuacaccgcccaguacacccccaagcugggccagauccagaucggcaccuggcagaccgacgaccugaccgugaaccagcccgugaaguucacccccgugggccugaacgacaccgagcacuucaaccaguggguggugcccagauacgccggcgcccugaaccugaacaccaaccuggcccccagcguggcccccguguuccccggcgagagacugcuguucuucagaagcuacaucccccugaagggcggcuacggcaaccccgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagagugcaguga

SEQ ID NO: 23939 - RNA, 1629 nt, Artificial Sequence
  derived and/or modified sequence opt4 from capsid_protein__Norovirus__BAG68711
augaagauggccagcaacgacgccgcccccagcaccgacggcgccgccggccuggugcccgagagcaacaacgaggugauggcccuggagcccguggccggcgccgcccuggccgcccccgugaccggccagaccaacaucaucgaccccuggaucagagccaacuucgugcaggcccccaacggcgaguucaccgugagccccagaaacgcccccggcgaggugcugcugaaccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccguggagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauuccccgugagcaucgaccagauguacaccagccccaacgaggugaucagcgugcagugccagaacggcagaugcacccuggacggcgagcugcagggcaccacccagcugcaggugagcggcaucugcgccuucaagggcgaggugaccgcccaccugcacgacaacgaccaccuguacaacgugaccaucaccaaccugaacggcagccccuucgaccccagcgaggacauccccgccccccugggcgugcccgacuuccagggcagaguguucggcgugaucagccagagagacaagcacaucgccagcggccacaacgagcccgccaacagaggccacgacgccguggugcccaccuacaccgcccaguacacccccaagcugggccagauccagaucggcaccuggcagaccgacgaccugaccgugaaccagcccgugaaguucacccccgugggccugaacgacaccgaccacuucaaccaguggguggugcccagauacgccggcgcccugaaccugaacaccaaccuggcccccagcguggcccccguguuccccggcgagagacugcuguucuucagaagcuacaucccccugaagggcggcuacggcaaccccgccaucgacugccugcugccccaggagugggugcagcacuucuaccaggagagcgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagaacccaguga

SEQ ID NO: 23940 - RNA, 1629 nt, Artificial Sequence
  derived and/or modified sequence opt4 from capsid_protein__Norovirus__BAG68712
augaagauggccagcaacgacgccgcccccagcaccgacggcgccgccggccuggugcccgagagcaacaacgaggugauggcccuggagcccguggccggcgccgcccuggccgcccccgugaccggccagaccaacaucaucgaccccuggaucagagccaacuucgugcaggcccccaacggcgaguucaccgugagccccagaaacgcccccggcgaggugcugcugaaccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccguggagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauuccccgugagcaucgaccagauguacaccagccccaacgaggugaucagcgugcagugccagaacggcagaugcacccuggacggcgagcugcagggcaccacccagcugcaggugagcggcaucugcgccuucaagggcgaggugaccgcccaccugcacgacaacgaccaccuguacaacgugaccaucaccaaccugaacggcagccccuucgaccccagcgaggacauccccgccccccugggcgugcccgacuuccagggcagaguguucggcgugaucagccagagagacaagcacaacgccagcggccacaacgagcccgccaacagaggccacgacgccguggugcccaccuacaccgcccaguacacccccaagcugggccagauccagaucggcaccuggcagaccgacgaccugaccgugaaccagcccgugaaguucacccccgugggccugaacgacaccgagcacuucaaccaguggguggugcccagauacgccggcgcccugaaccugaacaccaaccuggcccccagcguggcccccguguuccccggcgagagacugcuguucuucagaagcuacaucccccugaagggcggcuacggcaaccccgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagagugcaguga

SEQ ID NO: 23941 - RNA, 1629 nt, Artificial Sequence; identical to SEQ ID NO: 23940
  derived and/or modified sequence opt4 from capsid_protein__Norovirus__BAG68713

SEQ ID NO: 23942 - RNA, 1629 nt, Artificial Sequence
  derived and/or modified sequence opt4 from capsid_protein__Norovirus__BAG68714
augaagauggccagcaacgacgccgcccccagcaccgacggcgccgccggccuggugcccgagagcagcaacgaggugauggcccuggagcccguggccggcgccgcccuggccgcccccgugaccggccagaccaacaucaucgaccccuggaucagagccaacuucgugcaggcccccaacggcgaguucaccgugagccccagaaacgcccccggcgaggugcugcugaaccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccguggagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauuccccgugagcaucgaccagauguacaccagccccaacgaggugaucagcgugcagugccagaacggcagaugcacccuggacggcgagcugcagggcaccacccagcugcaggugagcggcaucugcgccuucaagggcgaggugaccgcccaccugcacgacaacgaccaccuguacaacgugaccaucaccaaccugaacggcagccccuucgaccccagcgaggacauccccgccccccugggcgugcccgacuuccagggcagaguguucggcgugaucagccagagagacaagcacaacgccagcggccacaacgagcccgccaacagaggccacgacgccguggugcccaccuacaccgcccaguacacccccaagcugggccaggugcagaucggcaccuggcagaccgacgaccugaccgugaaccagcccgugaaguucacccccgugggccugaacgacaccgagcacuucaaccaguggguggugcccagauacgccggcgcccugaaccugaacaccaaccuggcccccagcguggcccccguguuccccggcgagagacugcuguucuucagaagcuacaucccccugaagggcggcuacggcaaccccgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagagugcaguga

SEQ ID NO: 23943 - RNA, 1629 nt, Artificial Sequence
  derived and/or modified sequence opt4 from capsid_protein__Norovirus__BAG68715
augaagauggccagcaacgacgccgcccccagcaccgacggcgccgccggccuggugcccgagagcaacaacgaggugauggcccuggagcccguggccggcgccgcccuggccgcccccgugaccggccagaccaacaucaucgaccccuggaucagagccaacuucgugcaggcccccaacggcgaguucaccgugagccccagaaacgcccccggcgaggugcugcugaaccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccguggagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauuccccgugagcaucgaccagauguacaccagccccaacgaggugaucagcgugcagugccagaacggcagaugcacccuggacggcgagcugcagggcaccacccagcugcaggugagcggcaucugcgccuucaagggcgaggugaccgcccaccugcacgacaacgaccaccuguacaacgugaccaucaccaaccugaacggcagccccuucgaccccagcgaggacauccccgccccccugggcgugcccgacuuccagggcagaguguucggcgugaucagccagagagacaagcacaacagccccggccacaacgagcccgccaacagaggccacgacgccguggugcccaccuacaccgcccaguacacccccaagcugggccagauccagaucggcaccuggcagaccgacgaccugaccgugaaccagcccgugaaguucacccccgugggccugaacgacaccgagcacuucaaccaguggguggugcccagauacgccggcgcccugaaccugaacaccaaccuggcccccagcguggcccccguguuccccggcgagagacugcuguucuucagaagcuacaucccccugaagggcggcuacggcaaccccgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagagugcaguga

SEQ ID NO: 23944 - RNA, 1629 nt, Artificial Sequence; identical to SEQ ID NO: 22464
  derived and/or modified sequence opt4 from capsid_protein__Norovirus__BAG68716

SEQ ID NO: 23945 - RNA, 1647 nt, Artificial Sequence
  derived and/or modified sequence opt4 from capsid_protein__Norovirus__BAG68799
augaagauggccagcaacgacgccgcccccagcaacgacggcgccgccggccuggugcccgagaucaacaacgaggccauggcccuggagcccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgccuucaccgccggcaagaucaucuucgccgccaucccccccaacuuccccaucgacaaccugagcgccgcccagaucaccaugugcccccacgugaucguggacgugagacagcuggagcccgugaaccugcccaugcccgacgugagaaacaacuucuuccacuacaaccagggcagcgacagcagacugagacugaucgccaugcuguacaccccccugagagccaacaacagcggcgacgacguguucaccgugagcugcagagugcugaccagacccagccccgacuucagcuucaacuuccuggugccccccaccguggagagcaagaccaagcccuucagccugcccauccugaccaucagcgagaugagcaacagcagauuccccgugcccaucgacagccugcacaccagccccaccgagaacaucguggugcagugccagaacggcagagugacccuggacggcgagcugaugggcaccacccagcugcugcccagccagaucugcgccuucagaggcgugcugaccagaagcaccagcagagccagcgaccaggccgacaccgccacccccagacuguucaacuacuacuggcacauccagcuggacaaccugaacggcacccccuacgaccccgccgaggacauccccggcccccugggcacccccgacuucagaggcaagguguucggcguggccagccagagaaaccccgacgccaccaccagagcccacgaggccaagaucgacaccgccagcggcagauucacccccaagcugggcagccuggagaucagcaccgagagcgacgacuucgaccagaacaagcccaccagauucacccccgugggcaucggcguggaccacgaggaggacuuccagcaguggacccugcccgacuacgccggccaguucacccacaacaugaaccuggcccccgccguggcccccaacuuccccggcgagcagcugcuguucuucagaagccagcugcccagcagcggcggcagaagcaacggcauccuggacugccuggugccccaggagugggugcagcacuucuaccaggagagcgcccccagccagagccagguggcccuggugagauacaucaaccccgacaccggcagagugcuguucgaggccaagcugcacaagcugggcuucaugaccaucgccaagaacggcgacagccccaucaccgugccccccaacggcuacuucagauucgagagcugggugaaccccuucuacacccuggcccccaugggcaccggcaacggcagaagaagaauccaguga

SEQ ID NO: 23946 - RNA, 1647 nt, Artificial Sequence
  derived and/or modified sequence opt4 from capsid_protein__Norovirus__BAG68800
augaagauggccagcaacgacgccgcccccagcaacgacggcgccgccggccuggugcccgagaucaacaacgaggccauggcccuggagcccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgccuucaccgccggcaagaucaucuucgccgccaucccccccaacuuccccaucgacaaccugagcgccgcccagaucaccaugugcccccacgugaucguggacgugagacagcuggagcccgugaaccugcccaugcccgacgugagaaacaccuucuuccacuacaaccagggcagcgacagcagacugagacugaucgccaugcuguacaccccccugagagccaacaacagcggcgacgacguguucaccgugagcugcagagugcugaccagacccagccccgacuucagcuucaacuuccuggugccccccaccguggagagcaagaccaagcccuucagccugcccauccugaccaucagcgagaugagcaacagcagauuccccgugcccaucgacagccugcacaccagccccaccgagaacaucguggugcagugccagaacggcagagugacccuggacggcgagcugaugggcaccacccagcugcugcccagccagaucugcgccuucagaggcgugcugaccagaagcaccagcagagccagcgaccaggccgacaccgccacccccagacuguucgacuacuacuggcacauccagcuggacaaccugaacggcacccccuacgaccccgccgaggacauccccggcccccugggcacccccgacuucagaggcaagguguucggcguggccagccagagaaaccccgacaccaccaccagagcccacgaggccaagaucgacaccgccagcggcagauucacccccaagcugggcagccuggagaucagcaccgagagcgacgacuucgaccagaacaagcccaccagauucacccccgugggcaucggcguggaccacgaggaggacuuccagcaguggacccugcccaacuacgccggccaguucacccacaacaugaaccuggcccccgccguggcccccaacuuccccggcgagcaggugcuguucuucagaagccagcugcccagcagcggcggcagaagcaacggcauccuggacugccuggugccccaggagugggugcagcacuucuaccaggagagcgcccccagccagagccagguggcccuggugagauacgugaaccccgacaccggcagagugcuguucgaggccaagcugcacaagcugggcuucaugaccaucgccagaaacggcgacagccccaucaccgugccccccaacggcuacuucagauucgagagcugggugaaccccuucuacacccuggcccccaugggcaccggcaacggcagaagaagaauccaguga

SEQ ID NO: 23947 - RNA, 1623 nt, Artificial Sequence; identical to SEQ ID NO: 22538
  derived and/or modified sequence opt4 from capsid_protein__Norovirus__BAG68801

SEQ ID NO: 23948 - RNA, 1623 nt, Artificial Sequence
  derived and/or modified sequence opt4 from capsid_protein__Norovirus__BAG68802
augaagauggccagcaacgacgccacccccagcgacggcagcaccgccaaccuggugcccgaggugaacaacgaggugauggcccuggagcccguggccggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccaacacccagaacuacaccaugaaccuggccagccagaacuggaacaacuacgaccccaccgaggagauccccgccccccugggcacccccgacuucgugggcagaauccagggcgugcugacccagaccaccagaggcgacggcagcaccagaggccacaaggccaccgugagcaccggcagcgugcacuucacccccaagcugggcagcgugcaguucagcaccgacaccagcaacgaccuggagaccggccagaacaccagauucacccccgugggcguggugcaggacggcggcaccacccacagaaacgagccccagcagugggugcugcccgacuacagcggcagagacagccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggagagcgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagagcccuguga

SEQ ID NO: 23949 - RNA, 1623 nt, Artificial Sequence
  derived and/or modified sequence opt4 from capsid_protein__Norovirus__BAG68803
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaaggaggacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23950 - RNA, 1623 nt, Artificial Sequence; identical to SEQ ID NO: 22522
  derived and/or modified sequence opt4 from capsid_protein__Norovirus__BAG68804

SEQ ID NO: 23951 - RNA, 1623 nt, Artificial Sequence
  derived and/or modified sequence opt4 from capsid_protein__Norovirus__BAG68805
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacagcuacgccggcggcuucgaggugcaggugauccuggccggcaacgccuucaccgccggcaagaucguguucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagagacuguucaccggccccagcagcgccuucguggugcagccccagaacggcagaugcaccaccgacggcgugcugcugggcaccacccagcugagccccgugaacaucugcaccuucagaggcgacgugacccacaucgccggcacccaggaguacaccaugaaccuggccagccagaacuggaacaacuacgaccccaccgaggaggugcccgccccccugggcacccccgacuucaugggcaagauccagggcgugcugacccagaccaccagaagagacggcagcaccagaggccacaaggccaccgugagcaccggcagcgugcacuucacccccaagcugggcagaauccaguucagcaccgacaccagcaacgacuucgagaccggccagaacaccagauucacccccgugggcguggugcaggacggcagcaccacccaccagaacgagccccagcagugggugcugcccaacuacagcggcagagacagccacaacgugcaccuggcccccgccguggcccccagcuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugagccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23952 - RNA, 1623 nt, Artificial Sequence
  derived and/or modified sequence opt4 from capsid_protein__Norovirus__BAG68806
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucguguucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucaucgugcagccccagaacggcagaugcaccaccgacggcgugcugcugggcaccacccagcugagccccgugaacaucugcaccuucagaggcgacgugacccacaucgccggcacccaggaguacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcgugcacuucacccccaagcugggcagaauccaguucagcaccgacaccagcaacgacuucgagaccggccagaacaccagauucacccccgugggcguggugcaggacggcagcaccacccaccagaacgagccccagcagugggugcugcccaacuaccugggcagagacagccacaacgugcaccuggcccccgccguggcccccagcuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23953 - RNA, 1647 nt, Artificial Sequence
  derived and/or modified sequence opt4 from capsid_protein__Norovirus__BAG68807
augaagauggccagcagcgacgccacccccagcaacgacggcgccgccggccuggugcccgagaucaacaacgaggccauggcccuggaccccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgccuucaccgccggcaagaucaucuucgccgccaucccccccaacuuccccaucgacaaccugagcgccgcccagaucaccaugugcccccacgugaucguggacgugagacagcuggagcccgugaaccugcccaugcccgacgugagaaacaacuucuuccacuacaaccagggcagcgacagcagacugagacugaucgccaugcuguacaccccccugagagccaacaacagcggcgacgacguguucaccgugagcugcagagugcugaccagacccagccccgacuucagcuucaacuuccuggugccccccaccguggagagcaagaccaagcccuucacccugcccauccugaccaucagcgagaugagcaacagcagauuccccgugcccaucgacagccugcacaccagccccaccgagaacaucguggugcagugccagaacggcagagugacccuggacggcgagcugaugggcaccacccagcugcugcccagccagaucugcgccuucagaggcgugcugaccagaagcaccagcagagccagcgaccaggccgacaccgccacccccagacuguucaacuacuacuggcacauccagcuggacaaccugaacggcacccccuacgaccccgccgaggacauccccggcccccugggcacccccgacuucagaggcaagguguucggcguggccagccagagaaaccccgacagcaccaccagagcccacgaggccaagguggacaccaccgccggcagauucacccccaagcugggcagccuggagaucagcaccgagagcgacgacuucgaccagaaccagcccaccagauucacccccgugggcaucggcguggaccacgaggccgacuuccagcaguggagccugcccgacuacagcggccaguucacccacaacaugaaccuggcccccgccguggcccccaacuuccccggcgagcagcugcuguucuucagaagccagcugcccagcagcggcggcagaagcaacggcauccuggacugccuggugccccaggagugggugcagcacuucuaccaggagagcgcccccgcccagacccagguggcccuggugagauacgugaaccccgacaccggcagagugcuguucgaggccaagcugcacaagcugggcuucaugaccaucgccaagaacggcgacagccccaucaccgugccccccaacggcuacuucagauucgagagcugggugaaccccuucuacacccuggcccccaugggcaccggcaacggcagaagaagaauccaguga

SEQ ID NO: 23954 - RNA, 1623 nt, Artificial Sequence
  derived and/or modified sequence opt4 from capsid_protein__Norovirus__BAG68808
augaagauggccagcaacgacgccacccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgacagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccagaacuacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcgugcacuucacccccaagcugggcagcgugcaguucagcaccgacaccagcaacgaccuggagaccggccagaacaccagauucacccccgugggcguggugcaggacggcagcaccacccaccagaacgagccccagcagugggugcugcccgacuacagcggcagagacagccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggagagcgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagagcccuguga

SEQ ID NO: 23955 - RNA, 1623 nt, Artificial Sequence
  derived and/or modified sequence opt4 from capsid_protein__Norovirus__BAG68809
augaagauggccagcaacgacgccacccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgacagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccagaacuacaccaugaaccuggccagccagaacuggaacaacuacgaccccaccgaggagauccccgccccccugggcacccccgacuucgugggcaagauccagggcgugcugacccagaccaccagaggcgacggcagcaccagaggccacaaggccaccgugagcaccggcagcgugcacuucacccccaagcugggcagcgugcaguucagcaccgacaccagcaacgaccuggagaccggccagaacaccagauucacccccgugggcguggugcaggacggcagcaccacccaccagaacgagccccagcagugggugcugcccaacuacagcggcagagacagccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggagagcgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagagcccuguga

SEQ ID NO: 23956 - RNA, 1623 nt, Artificial Sequence
  derived and/or modified sequence opt4 from capsid_protein__Norovirus__BAG68810
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacagcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccaggaguacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcgugcacuucacccccaagcugggcagaauccaguucagcaccgacaccagcaacgacuucgagaccggccagaacaccagauucacccccgugggcguggugcaggacggcagcaccacccaccagaacgagccccagcagugggugcugcccaacuacagcggcagagacggccacaacgugcaccuggcccccgccguggcccccagcuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23957 - RNA, 1623 nt, Artificial Sequence
  derived and/or modified sequence opt4 from capsid_protein__Norovirus__BAG68811
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacagcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccaacacccaggaguacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcgugcacuucacccccaagcugggcagaauccaguucagcaccgacaccagcaacgacuucgagaccggccagaacaccagauucacccccgugggcguggugcaggacggcagcaccacccaccagaacgagccccagcagugggugcugcccaacuacagcggcggcgacggccacaacgugcaccuggcccccgccguggcccccagcuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23958 - RNA, 1623 nt, Artificial Sequence; identical to SEQ ID NO: 23085
  derived and/or modified sequence opt4 from capsid_protein__Norovirus__BAG68812

SEQ ID NO: 23959 - RNA, 1623 nt, Artificial Sequence
  derived and/or modified sequence opt4 from capsid_protein__Norovirus__BAG68813
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccugagcagaauguacaacagcuacgccggcggcuucgaggugcaggugauccuggccggcaacgccuucaccgccggcaagaucaucuucgccgccgugccccccaacuuccccaucgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccacccccguggagaagcuguucaccggccccagcagcgccuucaucgugcagccccagaacggcagaugcaccaucgacggcgugcugcugggcaccacccagcugagccccgugaacaucugcaccuucagaggcgacgugacccacaucgccggcacccaggaguacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcgugcacuucacccccaagcugggcagaauccaguucagcaccgacaccagcaacgacuucgagaccagacagaacaccagauucacccccgugggcgugauccaggacggcagcaccacccaccagaacgagccccagcagugggugcugcccaacuacagcggcagagacagccacaacgugcaccuggcccccgccguggcccccagcuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugauguucgagugcaagcugcacaagagcggcuacaucaccguggcccacaccggccagcacgaccuggugaucccccccaacggcuacuucagauucgacgccugggugaaccaguucuacacccuggcccccaugggcaacggcaccggcagaagaagagcccuguga

SEQ ID NO: 23960 - RNA, 1647 nt, Artificial Sequence
  derived and/or modified sequence opt4 from capsid_protein__Norovirus__BAG68814
augaagauggccagcaacgacgccgcccccagcaacgacggcgccgccggccuggugcccgagaucaacaacgaggccauggcccuggagcccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgccuucaccgccggcaagaucaucuucgccgccaucccccccaacuuccccaucgacaaccugagcgccgcccagaucaccaugugcccccacgugaucguggacgugagacagcuggagcccgugaaccugcccaugcccgacgugagaaacaacuucuuccacuacaaccagggcagcgacagcagacugagacugaucgccaugcuguacaccccccugagagccaacaacagcggcgacgacguguucaccgugagcugcagagugcugaccagacccagccccgacuucagcuucaacuuccuggugccccccaccguggagagcaagaccaagcccuucagccugcccauccugaccaucagcgagaugagcaacagcagauuccccgugcccaucgacagccugcacaccagccccaccgagaacaucguggugcagugccagaacggcagagugacccuggacggcgagcugaugggcaccacccagcugcugcccagccagaucugcgccuucagaggcgugcugaccagaagcaccagcagagccagcgaccaggccgacaccgccacccccagacuguucaacuacuacuggcacauccagcuggacaaccugaacggcacccccuacgaccccgccgaggacauccccggcccccugggcacccccgacuucagaggcaagguguucggcguggccagccagagaaaccccgacaccaccaccagagcccacgaggccaagaucgacaccaccagcggcagauucacccccaagcugggcagccuggagaucagcaccgagagcgacgacuucgaccagaacaagcccaccagauucacccccgugggcaucggcguggacagagagguggacuuccagcagugggcccugcccgacuacgccggccaguucacccacaacaugaaccuggcccccgccguggcccccaacuuccccggcgagcagcugcuguucuucagaagccagcugcccagcagcggcggcagaagcaacggcauccuggacugccuggugccccaggagugggugcagcacuucuaccaggagagcgcccccagccagagccagguggcccuggugagauacaucaaccccgacaccggcagagugcuguucgaggccaagcugcacaagcugggcuucaugaccaucgccaagaacggcgacagccccaucaccgugccccccaacggcuacuucagauucgagagcugggugaaccccuucuacacccuggcccccaugggcaccggcaacggcagaagaagaauccaguga

SEQ ID NO: 23961 - RNA, 1647 nt, Artificial Sequence
  derived and/or modified sequence opt4 from capsid_protein__Norovirus__BAG68815
augaagauggccagcaacgacgccgcccccagcaacgacggcgccgccggccuggugcccgagaucaacaacgaggccauggcccuggagcccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgccuucaccgccggcaagaucaucuucgccgccaucccccccaacuuccccaucgacaaccugagcgccgcccagaucaccaugugcccccacgugaucguggacgugagacagcuggagcccgugaaccugcccaugcccgacgugagaaacaacuucuuccacuacaaccagggcagcgacagcagacugagacugaucgccaugcuguacaccccccugagagccaacaacagcggcgacgacguguucaccgugagcugcagagugcugaccagacccagccccgacuucagcuucaacuuccuggugccccccaccguggagagcaagaccaagcccuucagccugcccauccugaccaucagcgagaugagcaacagcagauuccccgugcccaucgacagccugcacaccagccccaccgagaacaucguggugcagugccagaacggcagagugacccuggacggcgagcugaugggcaccacccagcugcugcccagccagaucugcgccuucagaggcgugcugaccagaagcaccagcagagccagcgaccaggccgacaccgccacccccagacuguucaacuacuacuggcacauccagcuggacaaccugaacggcacccccuacgaccccgccgaggacauccccggcccccugggcacccccgacuucagaggcaagguguucggcguggccagccagagaaaccccgacaccaccaccagagcccacgaggccaagaucgacaccaccagcggcagauucacccccaagcugggcagccuggagaucagcaccgagagcgacgacuucgaccagaacaagcccaccagauucacccccgugggcaucggcguggaccacgagguggacuuccagcagugggcccugcccgacuacgccggccaguucacccacaacaugaaccuggcccccgccguggcccccaacuuccccggcgagcagcugcuguucuucagaagccagcugcccagcagcggcggcagaagcaacggcauccuggacugccuggugccccaggagugggugcagcacuucuaccaggagagcgcccccagccagagccagguggcccuggugagauacaucaaccccgacaccggcagagugcuguucgaggccaagcugcacaagcugggcuucaugaccaucgccaagaacggcgacagccccaucaccgugccccccaacggcuacuucagauucgagagcugggugaaccccuucuacacccuggcccccaugggcaccggcaacggcagaagaagaauccaguga

SEQ ID NO: 23962 - RNA, 1623 nt, Artificial Sequence
  derived and/or modified sequence opt4 from capsid_protein__Norovirus__BAG68816
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaugaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccaggaguacaccaugaaccuggccagccagaacuggaacaacuacgaccccaccgaggagauccccgccccccugggcacccccgacuucgugggcaagauccagggcgugcugacccagaccaccagaggcgacggcagcaccagaggccacaaggccaccgugagcaccggcagcgugcacuucacccccaagcugggcagaauccaguucagcaccgacaccagcaacgacuucgagaccggccagaacaccagauucacccccgugggcguggugcaggacggcagcaccacccaccagaacgagccccagcagugggugcugcccaacuacagcggcagagacagccacaacgugcaccuggcccccgccguggcccccagcuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23963 - RNA, 1626 nt, Artificial Sequence
  derived and/or modified sequence opt4 from capsid_protein__Norovirus__BAH04374
augagaaugagcgacggcgccgcccccaaggccaacggcagcgaggccagcggccaggaccuggugcccaccgccguggagcaggccgugcccauccagcccguggccggcgccgcccuggccgcccccgccgccggccagaucaaccagaucgaccccuggaucuuccagaacuucgugcagugcccccugggcgaguucagcaucagccccagaaacacccccggcgagauccuguucgaccuggcccugggccccggccugaaccccuaccuggcccaccugagcgccauguacaccggcugggugggcaacauggaggugcagcuggugcuggccggcaacgccuucaccgccggcaagguggugguggcccuggugccccccuacuuccccaagggcagccugaccaccgcccagaucaccugcuucccccacgugaugugcgacgugagaacccuggagcccauccagcugccccugcuggacgugagaagagugcuguggcacgccacccaggaccaggaggagagcaugagacuggugugcaugcuguacaccccccugagaaccaacagccccggcgacgagagcuucguggugagcggcagacugcugagcaagcccgccgccgacuucaacuucguguaccugaccccccccaucgagagaaccaucuacagaaugguggaccugcccgugcugcagcccagacugugcacccacgccagauggcccgcccccaucuacggccugcugguggaccccagccugcccagcaacccccaguggcagaacggcagagugcacguggacggcacccugcugggcaccacccccgugagcggcagcugggugagcugcuucgccgccgaggccgccuacgaguuccagagcggcaccggcgagguggccaccuucacccugaucgagcaggacggcagcgccuacgugcccggcgacagagccgccccccugggcuaccccgacuucagcggccagcuggagaucgaggugcagaccgagaccaccaagaagggcgagaagcugaaggugaccaccuucgagaugauccugggccccaccaccaacguggaccaggugcccuaccagggcagaguguacgccagccugaccgccgccgccagccuggaccugguggacggcagagugagagccgugcccagaagcguguacggcuuccaggacguggugcccgaguacaacgacggccugcuggugccccuggccccccccaucggccccuuccugcccggcgaggugcugcugagauucagaaccuacaugagacagaucgacagcaccgacgccgccgccgaggccaucgacugcgcccugccccaggaguucgugagcugguucgccagcaacgccuucaccgugcagagcgaggcccugcugcugagauacagaaacacccugaccggccagcugcuguucgagugcaagcuguacagcgagggcuacaucgcccugagcuacagcggcagcggcccccugaccuuccccaccgacggcuucuucgagguggugagcugggugcccagacuguaccagcuggccagcgugggcagccuggccaccggcagaacccugaagcaguga

SEQ ID NO: 23964 - RNA, 1626 nt, Artificial Sequence
  derived and/or modified sequence opt4 from capsid_protein__Norovirus__BAH04377
augagaaugagcgacggcgccgcccccaaggccaacggcagcgaggccagcggccaggaccuggugcccaccgccguggagcaggccgugcccauccagcccguggccggcgccgcccuggccgcccccgccgccggccagaucaaccagaucgaccccuggaucuuccagaacuucgugcagugcccccugggcgaguucagcaucagccccagaaacacccccggcgagauccuguucgaccuggcccugggccccggccugaaccccuaccuggcccaccugagcgccauguacaccggcugggugggcaacauggaggugcagcuggugcuggccggcaacgccuucaccgccggcaagguggugguggcccuggugccccccuacuuccccaagggcagccugaccaccgcccagaucaccugcuucccccacgugaugugcgacgugagaacccuggagcccauccagcugccccugcuggacgugagaagagugcuguggcacgccacccaggaccaggaggagagcaugagacuggugugcaugcuguacaccccccugagaaccaacagccccggcgacgagagcuucguggugagcggcagacugcugagcaagcccgccgccgacuucaacuucguguaccugaccccccccaucgagagaaccaucuacagaaugguggaccugcccgugcugcagcccagacugugcacccacgccagauggcccgcccccaucuacggccugcugguggaccccagccugcccagcaacccccaguggcagaacggcagagugcacguggacggcacccugcugggcaccacccccgugagcggcagcugggugagcugcuucgccgccgaggccgccuacgaguuccagagcggcaucggcgagguggccaccuucacccugaucgagcaggacggcagcgccuacgugcccggcgacagagccgccccccugggcuaccccgacuucagcggccagcuggagaucgaggugcagaccgagaccaccaagaagggcgagaagcugaaggugaccaccuucgagaugauccugggccccaccaccaacguggaccaggugcccuaccagggcagaguguacgccagccugaccgccgccgccagccuggaccugguggacggcagagugagagccgugcccagaagcguguacggcuuccaggacguggugcccgaguacaacgacggccugcuggugccccuggccccccccaucggccccuuccugcccggcgaggugcugcugagauucagaaccuacaugagacagaucgacagcaccgacgccgccgccgaggccaucgacugcgcccugccccaggaguucgugagcugguucgccagcaacgccuucaccgugcagagcgaggcccugcugcugagauacagaaacacccugaccggccagcugcuguucgagugcaagcuguacagcgagggcuacaucgcccugagcuacagcggcagcggcccccugaccuuccccaccgacggcuucuucgagguggugagcugggugcccagacuguaccagcuggccagcgugggcagccuggccaccggcagaacccugaagcaguga

SEQ ID NO: 23965 - RNA, 1623 nt, Artificial Sequence; identical to SEQ ID NO: 23225
  derived and/or modified sequence opt4 from capsid_protein__Norovirus__BAH29786

SEQ ID NO: 23966 - RNA, 1623 nt, Artificial Sequence
  derived and/or modified sequence opt4 from capsid_protein__Norovirus__BAH30707
augaagauggccagcaacgacgccacccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccacccagaacuggaacagcuacgaccccaccgaggagauccccgccccccugggcacccccgacuucgugggcaagauccagggcgugcugacccagaccaccagagccgacggcagcaccagaggccacaaggccaccguguacaccggcagcgccgacuucgcccccaagcugggcagagugcaguucgccaccgacaccgacaacgacuucgacgccaaccagaacaccaaguucacccccgugggcgugauccaggacggcaacaccgcccacagaaacgagccccagcagugggugcugcccagcuacagcggcagaaacagccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23967 - RNA, 1653 nt, Artificial Sequence
  derived and/or modified sequence opt4 from capsid_protein__Norovirus__BAL40869
augaagauggccagcaacgacgccgcccccagcaacgacggcgccgccaaccuggugcccgaggccaacaacgaggugauggcccuggagcccguggugggcgccagcaucgccgcccccguggugggccagcagaacaucaucgaccccuggaucagagagaacuucgugcaggccccccagggcgaguucaccgugagccccagaaacagccccggcgagaugcugcugaaccuggagcugggccccgagcugaaccccuaccugagccaccugagcagaauguacaacggcuacgccggcggcaugcaggugcagguggugcuggccggcaacgccuucaccgccggcaagaucaucuucgccgccgugcccccccacuuccccguggacaacaucagcgccgcccagaucaccaugugcccccacgugaucguggacgugagacagcuggagcccgugcugcugccccugcccgacaucagaaacagauucuuccacuacaaccaggagaacacccccagaaugagacugguggccaugcuguacaccccccugagagccaacagcggcgaggacguguucaccgugagcugcagagugcugaccagacccgcccccgacuucgaguucaccuuccuggugccccccaccguggagagcaagaccaagcccuucacccugcccauccugacccugggcgagcugagcaacagcagauuccccgccgccaucgacaugcuguacaccgaccccaacgagagcaucguggugcagccccagaacggcagaugcacccuggacggcacccugcagggcaccacccagcuggugcccacccagaucugcgccuucagaggcacccugaucagccagaccgccagagccguggacagcaccgacagcccccagagagccagagaccacccccugcacgugcaggugaagaaccuggacggcacccaguacgaccccaccgacgacauccccgccgugcugggcgccaucgacuucaagggcaccguguucggcguggccagccagagagacgugagcggcacccaggagcagggccacuacgccaccagagcccacgaggcccacaucgacaccaccgaccccaaguacgcccccaagcugggcaccauccugaucaagagcgagagccccgacuucaacaccaaccagcccaucagauucacccccgugggcaugggcgacaacaacuggagacagugggagcugcccgacuacagcggcagacugacccugaacaugaaccuggcccccgccgugagccccagcuuccccggcgagagaauccuguucuucagaagcaucgugcccagcgccggcggcuacggcagcggcuacaucgacugccugaucccccaggagugggugcagcacuucuaccaggaggccgcccccagccagagcgccguggcccuggugagauacgugaaccccgacaccggcagaaacaucuucgaggccaagcugcacagagagggcuuccugaccguggccaacagcggcaacaaccccaucguggugccccccaacggcuacuucagauucgaggccugggugaaccaguucuacacccuggcccccaugggcagcggccagggcagaagaagagcccaguga

SEQ ID NO: 23968 - RNA, 1644 nt, Artificial Sequence
  derived and/or modified sequence opt4 from capsid_protein__Norovirus__BAL40870
augaagauggccagcagcgacgccgcccccagcaacgacggcgccgccaaccuggugcccgaggccaacaacgaggugauggcccuggagcccguggugggcgccagcaucgccgcccccguggugggccagcagaacaucaucgaccccuggaucagagagaacuucgugcaggccccccagggcgaguucaccgugagccccagaaacagccccggcgagaugcugcugaaccuggagcugggccccgagcugaaccccuaccugagccaccugagcagaauguacaacggcuacgccggcggcaugcaggugcagguggugcuggccggcaacgccuucaccgccggcaagaucaucuucgccgccgugcccccccacuuccccguggagaacaucagcgccgcccagaucaccaugugcccccacgugaucguggacgugagacagcuggagcccgugcugcugccccugcccgacaucagaaacagauucuuccacuacaaccaggagaacacccccagaaugagacugguggccaugcuguacaccccccugagagccaacagcggcgaggacguguucaccgugagcugcagagugcugaccagacccgcccccgacuucgaguucaccuuccuggugccccccaccguggagagcaagaccaagcccuucacccugcccauccugacccugggcgagcugagcaacagcagauuccccgcccccaucgacaugcuguacaccgaccccaacgagggcaucguggugcagccccagaacggcagaugcacccuggacggcacccugcagggcaccacccagcuggugcccacccagaucugcgccuucagaggcacccugaucggccagaccagcagaagcagcgacagcaccgacagcgcccccagaagaagagaccacccccugcacgugcagcugaagaaccuggacggcacccaguacgaccccaccgacgaggugcccgccgugcugggcgccaucgacuucaagggcaccguguucggcguggccagccagagagacgugagcggccagcaggugggcgccaccagagcccacgaggugcacaucaacaccaccgaccccagauacacccccaagcugggcagcauccugaugcacagcgagagcgacgacuucgugaccggccagcccgugagauucacccccaucggcaugggcgacaacgacuggcaccagugggagcugcccgacuacagcggccaccugacccugaacaugaaccuggcccccgccguggcccccgccuuccccggcgagagaauccuguucuucagaagcaucgugcccagcgccggcggcuacggcagcggccagaucgacugccugaucccccaggagugggugcagcacuucuaccaggaggccgcccccagccagagcgccguggcccugaucagauacgugaaccccgacaccggcagaaacaucuucgaggccaagcugcacagagagggcuucaucaccguggccaacagcggcaacaaccccaucguggccccccccaacggcuacuucagauucgaggccugggugaaccaguucuacacccugacccccaugggcaccggccagggcagaagaagaaaccaguga

SEQ ID NO: 23969 - RNA, 1644 nt, Artificial Sequence
  derived and/or modified sequence opt4 from capsid_protein__Norovirus__BAL40871
augaagauggccagcaacgacgccgcccccagcaacgacggcgccgccaaccuggugcccgaggccaacaacgaggugauggcccuggagcccguggugggcgccagcaucgccgcccccguggugggccagcagaacaucaucgaccccuggaucagagagaacuucgugcaggccccccagggcgaguucaccgugagccccagaaacagccccggcgagaugcugcugaaccuggagcugggccccgagcugaaccccuaccugagccaccugagcagaauguacaacggcuacgccggcggcaugcaggugcagguggugcuggccggcaacgccuucaccgccggcaagaucaucuucgccgccgugcccccccacuuccccguggagaacaucagcgccgcccagaucaccaugugcccccacgugaucguggacgugagacagcuggagcccgugcugcugccccugcccgacaucagaaacagauucuuccacuacaaccaggagaacacccccagaaugagacugguggccaugcuguacaccccccugagagccaacagcggcgacgacguguucaccgugagcugcagagugcugaccagacccgcccccgacuucgaguucaccuuccuggugccccccaccguggagagcaagaccaagcccuucacccugcccauccugacccugggcgagcugagcaacagcagauuccccgcccccaucgacaugcuguacaccgaccccaacgagggcaucguggugcagccccagaacggcagaugcacccuggacggcacccugcagggcaccacccagcuggugcccacccagaucugcgccuucagaggcacccugaucggccagaccagcagaagcagcgacagcaccgacagcgcccccagaagaagagaccacccccugcacgugcagcugaagaaccuggacggcacccaguacgaccccaccgacgaggugcccgccgugcugggcgccaucgacuucaagggcaccguguucggcguggccagccagagagacgugagcggccagcaggugggcgccaccagagcccacgaggugcacaucaacaccaccgaccccagauacacccccaagcugggcagcauccugaugcacagcgagagcgacgacuucgugaccggccagcccgugagauucacccccaucggcaugggcgacaacgacuggcaccagugggagcugcccgacuacagcggccaccugacccugaacaugaaccuggcccccgccguggcccccgccuuccccggcgagagaauccuguucuucagaagcauggugcccagcgccggcggcuacggcagcggccagaucgacugccugaucccccaggagugggugcagcacuucuaccaggaggccgcccccagccagagcgccguggcccugaucagauacgugaaccccgacaccggcagaaacaucuucgaggccaagcugcacagagagggcuucaucaccguggccaacagcggcaacaaccccaucguggugccccccaacggcuacuucagauucgaggccugggugaaccaguucuacacccugacccccaugggcaccggccagggcagaagaagaaaccaguga

SEQ ID NO: 23970 - RNA, 1644 nt, Artificial Sequence
  derived and/or modified sequence opt4 from capsid_protein__Norovirus__BAL40872
augaagauggccagcaacgacgccgcccccagcaacgacggcgccgccaaccuggugcccgaggccaacaacgaggugauggcccuggagcccguggugggcgccagcaucgccgcccccguggugggccagcagaacaucaucgaccccuggaucagagagaacuucgugcaggccccccagggcgaguucaccgugagccccagaaacagccccggcgagaugcugcugaaccuggagcugggccccgagcugaaccccuaccugagccaccugagcagaauguacaacggcuacgccggcggcaugcaggugcagguggugcuggccggcaacgccuucaccgccggcaagaucaucuucgccgccgugcccccccacuuccccguggagaacaucagcgccgcccagaucaccaugugcccccacgugaucguggacgugagacagcuggagcccgugcugcugccccugcccgacaucagaaacagauucuuccacuacaaccaggaggacacccccagaaugagacugguggccaugcuguacaccccccugagagccaacagcggcgaggacguguucaccgugagcugcagagugcugaccagacccgcccccgacuucgaguucaccuuccuggugccccccaccguggagagcaagaccaagcccuucacccugcccauccugacccugggcgagcugagcaacagcagauuccccgcccccaucgacaugcuguacaccgaccccaacgagaccaucguggugcagccccagaacggcagaugcacccuggacggcacccugcagggcaccacccagcuggugcccacccagaucugcagcuucagaggcacccugaucagccagaccagcagaagcgccgacagcaccgacagcgcccccagagugagaaaccacccccugcacgugcagcugaagaaccuggacggcacccccuacgaccccaccgacgaggugcccgccgugcugggcgccaucgacuucaagggcaccguguucggcguggccagccagagaaacaccaccggcaacagcgugggcgccaccagagcccacgaggugcacaucgacaccaccaaccccagauacacccccaagcugggcagcgugcugaugaacagcgagagcagcgacuucgacgacggccagcccaccugcuucacccccaucggcaugggcgccgacgacuggcaccagugggagcugcccgaguacagcggccaccugacccugaacaugaaccuggcccccgccguggcccccgccuuccccggcgagagaauccuguucuucagaagcguggugcccagcgccggcggcuacggcagcggccagaucgacugccugaucccccaggagugggugcagcacuucuaccaggaggccgcccccagccagagcgccguggcccugaucagauacgugaaccccgacaccggcagaaacaucuucgaggccaagcugcacagagagggcuucaucaccguggccaacagcggcaacaaccccaucguggugccccccaacggcuacuucagauucgaggccugggugaaccaguucuacacccugacccccaugggcaccggccagggcagaagaagagugcaguga

SEQ ID NO: 23971 - RNA, 1644 nt, Artificial Sequence
  derived and/or modified sequence opt4 from capsid_protein__Norovirus__BAL40873
augaagauggccagcaacgacgccgcccccagcaacgacggcgccgccaaccuggugcccgaggccaacaacgaggugauggcccuggagcccguggccggcgccagcaucgccgcccccguggugggccagcagaacaucaucgaccccuggaucagagagaacuucgugcaggccccccagggcgaguucaccgugagccccagaaacagccccggcgagaugcugcugaaccuggagcugggccccgagcugaaccccuaccugagccaccugagcagaauguacaacggcuacgccggcggcaugcaggugcagguggugcuggccggcaacgccuucaccgccggcaagaucaucuucgccgccgugcccccccacuuccccguggagaacaucagcgccgcccagaucaccaugugcccccacgugaucguggacgugagacagcuggagcccgugcugcugccccugcccgacaucagaaacagauucuuccacuacaaccaggaggacacccccagaaugagacugguggccaugcuguacaccccccugagagccaacagcggcgaggacguguucaccgugagcugcagagugcugaccagacccgcccccgacuucgaguucaccuuccuggugccccccaccguggagagcaagaccaagcccuucacccugcccauccugacccugggcgagcugagcaacagcagauuccccgcccccaucgacaugcuguacaccgaccccaacgagaccaucguggugcagccccagaacggcagaugcacccuggacggcacccugcagggcaccacccagcuggugcccacccagaucugcagcuucagaggcacccugaucagccagaccagcagaagcgccgacagcaccgacagcgcccccagagugagaaaccacccccugcacgugcagcugaagaaccuggacggcacccccuacgaccccaccgacgaggugcccgccgugcugggcgccaucgacuucaagggcaccguguucggcguggccagccagagaaacaccaccggcaacagcgugggcgccaccagagcccacgaggugcacaucgacaccaccaaccccagauacacccccaagcugggcagcgugcugaugcacagcgagagcagcgacuucgacgacggccagcccaucagcuucacccccaucggcaugggcgccgacgacuggcaccagugggagcugcccgaguacagcggccaccugacccugaacaugaaccuggcccccgccguggcccccgccuuccccggcgagagaauccuguucuucagaagcguggugcccagcgccggcggcuacggcagcggccagaucgacugccugaucccccaggagugggugcagcacuucuaccaggaggccgcccccagccagagcgccguggcccuggugagauacgugaaccccgacaccggcagaaacaucuucgaggccaagcugcacagagagggcuuccugaccguggccaacagcggcaacaaccccaucguggugccccccaacggcuacuucagauucgaggccugggugaaccaguucuacacccugacccccaugggcaccggccagggcagaagaagagugcaguga

SEQ ID NO: 23972 - RNA, 1626 nt, Artificial Sequence
  derived and/or modified sequence opt4 from capsid_protein__Norovirus__BAL60900
augagaaugagcgacggcgccgcccccaaggccaacggcagcgaggccagcggccaggaccuggugcugaccgccguggagcaggccgugcccauccagcccguggccggcgccgcccuggccgcccccgccgccggccagaucaaccagaucgaccccuggaucuuccagaacuucgugcagugcccccugggcgaguucagcaucagccccagaaacacccccggcgagauccuguucgaccuggcccugggccccggccugaaccccuaccuggcccaccugagcgccauguacaccggcugggugggcaacauggaggugcagcuggugcuggccggcaacgccuucaccgccggcaagguggugguggcccuggugccccccuacuuccccaagggcagccugaccaccgcccagaucaccugcuucccccacgugaugugcgacgugagaacccuggagcccauccagcugccccugcuggacgugagaagagugcuguggcacgccacccaggaccaggaggagagcaugagacuggugugcaugcuguacaccccccugagaaccaacagccccggcgacgagagcuucguggugagcggcagacugcugagcaagcccgccgccgacuucaacuucguguaccugaccccccccaucgagagaaccaucuacagaaugguggaccugcccgugcugcagcccagacugugcacccacgccagauggcccgcccccguguacggccugcugguggaccccagccugcccagcaacccccaguggcagaacggcagagugcacguggacggcacccugcugggcaccacccccgugagcggcagcugggugagcugcuucgccgccgaggccgccuacgaguuccagagcggcaccggcgagguggccaccuucacccugaucgagcaggacggcagcgccuacgugcccggcgagagagccgccccccugggcuaccccgacuucagcggccagcuggagaucgaggugcagaccgagaccaccaagagaggcgagaagcugaaggugaccaccuucgagaugauccugggccccaccaccaacguggaccaggcccccuaccagggcagaguguacgccagccugagcgccgccgccagccuggaccugguggacggcagagugagagccgugcccagaagcaucuacggcuuccaggacgugauccccgaguacaacgacggccugcuggugccccuggccccccccaucggccccuuccugcccggcgaggugcugcugagauucagaaccuacaugagacagguggacagcagcgacgccgccgccgaggccaucgacugcgcccugccccaggaguucgugagcugguucgccagcaacggcuucaccgugcagagcgaggcccugcugcugagauacagaaacacccugaccggccagcugcuguucgagugcaagcuguacagcgagggcuacaucgcccugagcuacagcggcagcggcccccugaccuuccccaccgacggcuucuucgagguggugagcugggugcccagacuguaccagcuggccagcgugggcagccuggugaccggcagaacccugaagcaguga

SEQ ID NO: 23973 - RNA, 1623 nt, Artificial Sequence
  derived and/or modified sequence opt4 from capsid_protein__Norovirus__BAQ55211
augaagauggccagcaacgacgccagccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcaccagcaccuacagaaugaaccuggccagccagaacuggaacaacuacgaccccaccgaggagauccccgccccccugggcacccccgacuucgugggcaagauccagggcaugcugacccagaccaccaagggcgacggcagcaccagaggccacaaggccaccgugagcaccggcagcguggacuucacccccaagcugggcagcgugcaguucgccaccgacaccgacaacgacuucgagaccggccagaacaccagauucacccccgugggcgugauccaggacggcagcggcgcccacagaaacgagccccagcagugggugcugcccaacuacagcggcagaaccgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagaccggcuacgugaccguggcccacaccggccagcacgaccuggugaucccccccaacggcuacuucagauucgacagcugggugaaccaguucuacacccuggcccccaugggcaacggcgccggcagaagaagagcccuguga

SEQ ID NO: 23974 - RNA, 1623 nt, Artificial Sequence; identical to SEQ ID NO: 22378
  derived and/or modified sequence opt4 from capsid_protein__Norovirus__BAQ55212

SEQ ID NO: 23975 - RNA, 1620 nt, Artificial Sequence
  derived and/or modified sequence opt4 from capsid_protein__Norovirus__BAQ55213
augaagauggccagcaacgacgccagccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcaccagcaccuacagaaugaaccuggccagccagaacuggaacaacuacgaccccaccgaggagauccccgccccccugggcacccccgacuucgugggcaagauccagggcaugcugacccagaccaccaagggcgacggcagcaccagaggccacaaggccaccgugagcaccggcagcguggacuucacccccaagcugggcagcgugcaguucgacaccgacaccaacaacgaccuggagaccggccagaacaccagauucacccccgugggcgugauccaggacggcagcgcccacagaaacgagccccagcagugggugcugcccgacuacagcggcagaaccgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagaccggcuacgugaccguggcccacaccggccagcacgaccuggugaucccccccaacggcuacuucagauucgacagcugggugaaccaguucuacacccuggcccccaugggcaacggcgccggcagaagaagagcccuguga

SEQ ID NO: 23976 - RNA, 1623 nt, Artificial Sequence
  derived and/or modified sequence opt4 from capsid_protein__Norovirus__BAQ55214
augaagauggccagcaacgacgccagccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcaccagcaccuacagaaugaaccuggccagccagaacuggaacaacuacgaccccaccgaggagauccccgccccccugggcacccccgacuucgugggcaagauccagggcaugcugacccagaccaccaagggcgacggcagcaccagaggccacaaggccaccgugagcaccggcagcguggacuucacccccaagcugggcagcgugcaguucgccaccgacaccgacaacgacuucgagaccggccagaacaccagauucacccccgugggcgugauccaggacggcagcggcgcccacagaaacgagccccagcagugggugcugcccgacuacagcggcaagaccgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagaccggcuacgugaccguggcccacaccggccagcacgaccuggugaucccccccaacggcuacuucagauucgacagcugggugaaccaguucuacacccuggcccccaugggcaacggcgccggcagaagaagagcccuguga

SEQ ID NO: 23977 - RNA, 1620 nt, Artificial Sequence
  derived and/or modified sequence opt4 from capsid_protein__Norovirus__BAQ55215
augaagauggccagcaacgacgccagccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcaccagaaccuacagaaugaaccuggccagccagaacuggaacaacuacgaccccaccgaggagauccccgccccccugggcacccccgacuucgugggcaagauccagggcaugcugacccagaccaccaagggcgacggcagcaccagaggccacaaggccaccgugagcaccggcagcguggacuucacccccaagcugggcagcgugcaguucgacaccgacaccaacaacgaccuggagaccggccagaacaccagauucacccccgugggcgugauccaggacggcagcgcccacagaaacgagccccagcagugggugcugcccgacuacagcggcagaaccgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagaccggcuacgugaccguggcccacaccggccagcacgaccuggugaucccccccaacggcuacuucagauucgacagcugggugaaccaguucuacacccuggcccccaugggcaacggcgccggcagaagaagagcccuguga

SEQ ID NO: 23978 - RNA, 1620 nt, Artificial Sequence
  derived and/or modified sequence opt4 from capsid_protein__Norovirus__BAQ55216
augaagauggccagcaacgacgccagccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccagaucaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcaccagaaccuacagaaugaaccuggccagccagaacuggaacaacuacgaccccaccgaggagauccccgccccccugggcacccccgacuucgugggcaagauccagggcaugcugacccagaccaccaagggcgacggcagcaccagaggccacaaggccaccgugagcaccggcagcguggacuucacccccaagcugggcagcgugcaguucgacaccgacaccaacaacgaccuggagaccggccagaacaccagauucacccccgugggcgugauccaggacggcagcgcccacagaaacgagccccagcagugggugcugcccgacuacagcggcagaaccgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagaccggcuacgugaccguggcccacaccggccagcacgaccuggugaucccccccaacggcuacuucagauucgacagcugggugaaccaguucuacacccuggcccccaugggcaacggcgccggcagaagaagagcccuguga

SEQ ID NO: 23979 - RNA, 1620 nt, Artificial Sequence
  derived and/or modified sequence opt4 from capsid_protein__Norovirus__BAQ55217
augaagauggccagcaacgacgccagccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcacccacaccuacagaaugaaccuggccagccagaacuggaacaacuacgaccccaccgaggagauccccgccccccugggcacccccgacuucgugggcaagauccagggcaugcugacccagaccaccaagggcgacggcagcaccagaggccacaaggccaccgugagcaccggcagcguggacuucacccccaagcugggcagcgugcaguucgccaccgacaccaacaacgacuucgagaccggccagaacaccagauucacccccgugggcgugauccaggacggcagcgcccacagaaacgagccccagcagugggugcugcccgacuacagcggcaagaccgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagaccggcuacgugaccguggcccacaccggccagcacgaccuggugaucccccccaacggcuacuucagauucgacagcugggugaaccaguucuacacccuggcccccaugggcaacggcgccggcagaagaagagcccuguga

SEQ ID NO: 23980 - RNA, 1623 nt, Artificial Sequence
  derived and/or modified sequence opt4 from capsid_protein__Norovirus__BAQ55218
augaagauggccagcaacgacgccagccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccaacacccacaccuacagaaugaaccuggccagccagaacuggaacaacuacgaccccaccgaggagauccccgccccccugggcacccccgacuucgugggcaagauccagggcaugcugacccagaccaccaagggcgacggcagcaccagaggccacaaggccaccgugagcaccggcagcguggacuucacccccaagcugggcagcgugcaguucaccaccgacaccgacaacgacuucgagaccggccagaacaccagauucacccccgugggcgugauccaggacggcaacggcgcccacagaaacgagccccagcagugggugcugcccgacuacagcggcggcaccgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagaccggcuacgugaccguggcccacaccggccagcacgaccuggugaucccccccaacggcuacuucagauucgacagcugggugaaccaguucuacacccuggcccccaugggcaacggcgccggcagaagaagagcccuguga

SEQ ID NO: 23981 - RNA, 1623 nt, Artificial Sequence; identical to SEQ ID NO: 22591
  derived and/or modified sequence opt4 from capsid_protein__Norovirus__BAR47396

SEQ ID NO: 23982 - RNA, 1623 nt, Artificial Sequence; identical to SEQ ID NO: 23082
  derived and/or modified sequence opt4 from capsid_protein__Norovirus__BAR47397

SEQ ID NO: 23983 - RNA, 1623 nt, Artificial Sequence
  derived and/or modified sequence opt4 from capsid_protein__Norovirus__BAR47398
augaagauggccagcaacgacgccagccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccgcccugaacuggaacaacuacgaccccaccgaggagauccccgccccccugggcacccccgacuucgugggcaagauccagggcgugcugacccagaccaccaaggccgacggcagcaccagaggccacaaggccaccguguacaccggcagcgccgacuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgaccagggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23984 - RNA, 1623 nt, Artificial Sequence; identical to SEQ ID NO: 23122
  derived and/or modified sequence opt4 from capsid_protein__Norovirus__BAR47400

SEQ ID NO: 23985 - RNA, 1623 nt, Artificial Sequence
  derived and/or modified sequence opt4 from capsid_protein__Norovirus__BAR47401
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccacccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagagacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugagauucagcaccgacaccgagaacgacuucgagacccaccagaacaccaaguucacccccgugggcgugauccaggacggcagcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23986 - RNA, 1623 nt, Artificial Sequence
  derived and/or modified sequence opt4 from capsid_protein__Norovirus__BAR47403
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccaucuacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagagacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23987 - RNA, 1623 nt, Artificial Sequence; identical to SEQ ID NO: 22671
  derived and/or modified sequence opt4 from capsid_protein__Norovirus__BAR47404

SEQ ID NO: 23988 - RNA, 1623 nt, Artificial Sequence
  derived and/or modified sequence opt4 from capsid_protein__Norovirus__BAR47405
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcaugcugacccagaccaccaagggcgacggcagcaccagaggccacaaggccaccguguacaccggcagcacccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23989 - RNA, 1623 nt, Artificial Sequence; identical to SEQ ID NO: 23281
  derived and/or modified sequence opt4 from capsid_protein__Norovirus__BAR47406

SEQ ID NO: 23990 - RNA, 1623 nt, Artificial Sequence
  derived and/or modified sequence opt4 from capsid_protein__Norovirus__BAR47407
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcggcaacuacaccaugaaccuggccagcgugaacuggaacaacuacgaccccaccgaggagauccccgccccccugggcacccccgacuucgugggcaagauccagggcaugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcaacaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23991 - RNA, 1623 nt, Artificial Sequence
  derived and/or modified sequence opt4 from capsid_protein__Norovirus__BAR47408
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucaagaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccgcccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgccgacuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 23992 - RNA, 1623 nt, Artificial Sequence; identical to SEQ ID NO: 23407
  derived and/or modified sequence opt4 from capsid_protein__Norovirus__BAR47410

SEQ ID NO: 23993 - RNA, 1623 nt, Artificial Sequence
  derived and/or modified sequence opt4 from capsid_protein__Norovirus__BAR47412
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagaauccaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagaguggccuga

SEQ ID NO: 23994 - RNA, 1623 nt, Artificial Sequence
  derived and/or modified sequence opt4 from capsid_protein__Norovirus__BAR47413
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagaauccaguucgagaccgacaccgaccacgacuucgaggccaaccagaacaccaaguucacccccgugggcgugauccaggacggcggcaccacccacagaaacgagccccagcaguggaugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagaguggccuga

SEQ ID NO: 23995 - RNA, 1623 nt, Artificial Sequence; identical to SEQ ID NO: 23994
  derived and/or modified sequence opt4 from capsid_protein__Norovirus__BAR47414

SEQ ID NO: 23996 - RNA, 1623 nt, Artificial Sequence; identical to SEQ ID NO: 23994
  derived and/or modified sequence opt4 from capsid_protein__Norovirus__BAR47415

SEQ ID NO: 23997 - RNA, 1623 nt, Artificial Sequence; identical to SEQ ID NO: 22921
  derived and/or modified sequence opt4 from capsid_protein__Norovirus__BAR47417

SEQ ID NO: 23998 - RNA, 1623 nt, Artificial Sequence
  derived and/or modified sequence opt4 from capsid_protein__Norovirus__BAR47418
augaagauggccagcagcgacgccaacccccccgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagccacaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccaaccacgacuucgaggccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagccguguga

SEQ ID NO: 23999 - RNA, 1623 nt, Artificial Sequence
  derived and/or modified sequence opt4 from capsid_protein__Norovirus__BAR47421
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagccguguga

SEQ ID NO: 24000 - RNA, 1623 nt, Artificial Sequence; identical to SEQ ID NO: 22727
  derived and/or modified sequence opt4 from capsid_protein__Norovirus__BAR47422

SEQ ID NO: 24001 - RNA, 1623 nt, Artificial Sequence
  derived and/or modified sequence opt4 from capsid_protein__Norovirus__BAR47423
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgacagagacuucgaggccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgccaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24002 - RNA, 1623 nt, Artificial Sequence; identical to SEQ ID NO: 22729
  derived and/or modified sequence opt4 from capsid_protein__Norovirus__BAR47424

SEQ ID NO: 24003 - RNA, 1623 nt, Artificial Sequence; identical to SEQ ID NO: 23007
  derived and/or modified sequence opt4 from capsid_protein__Norovirus__BAR47426

SEQ ID NO: 24004 - RNA, 1623 nt, Artificial Sequence; identical to SEQ ID NO: 22671
  derived and/or modified sequence opt4 from capsid_protein__Norovirus__BAS53731

SEQ ID NO: 24005 - RNA, 1623 nt, Artificial Sequence
  derived and/or modified sequence opt4 from capsid_protein__Norovirus__BAS53732
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagagccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgccgacuucacccccaagcugggcagcgugcaguucggcaccgacaccgagaacgacuucgagacccaccagaacaccaaguucacccccgugggcgugauccaggacggcggcaccacccacagaaacgagccccagcagugggugcugcccagcuacagcggcagaaacgugcacaacgugcaccuggcccccgccguggcccccaacuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24006 - RNA, 1623 nt, Artificial Sequence
  derived and/or modified sequence opt4 from capsid_protein__Norovirus__BAS53733
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaucgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugagcuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24007 - RNA, 1623 nt, Artificial Sequence
  derived and/or modified sequence opt4 from capsid_protein__Norovirus__BAS53734
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgccgacuucacccccaagcugggcagcgugcaguucggcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaacuuccccggcgagcaguuccuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24008 - RNA, 1623 nt, Artificial Sequence
  derived and/or modified sequence opt4 from capsid_protein__Norovirus__BAS53945
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccacccccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcaugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcaacaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24009 - RNA, 1632 nt, Artificial Sequence
  derived and/or modified sequence opt4 from capsid_protein__Norovirus__CAK22261
augaugauggccagcaaggacgccagccccagcgccgacggcgccaacggcgccggccagcuggugcccgaggugaacaacgccgagccccugccccuggaccccguggccggcgccagcaccgcccuggccaccgccggccaggugaacaugaucgaccccuggaucuucaacaacuucgugcaggccccccagggcgaguucaccaucagccccaacaacacccccggcgacauccuguucgaccugcagcugggcccccaccugaaccccuuccuggcccaccugagccagauguacaacggcugggugggcaacaugagagugagagugauccuggccggcaacgccuucaccgccggcaaggugaucgugugcugcgugccccccggcuuccagagcagaacccugagcaucgcccaggccacccuguucccccacaucaucgccgacgugagaacccuggagcccaucgagaucccccuggaggacgugagaaacacccuguaccacaccaacgacaaccagcccaccaugagacugcugugcaugcuguacaccccccugagaaccggcggcggcagcggcggcaccgacgccuucgugguggccggcagagugcugaccugccccagcagcgacuucaacuuccuguuccuggugccccccaccguggagcagaagaccagacccuucagcgugcccaacaucccccugcagcugcugagcaacagcagagugcccaaccugauccagagcauggugcugagccccgaccaggcccagaacgugcaguuccagaacggcagaugcaccaccgacggccagcugcugggcaccacccccgugagcgugagccagauccugaaguucagaggcaaggugagcgccggcagcagagugaucaaccugaccgagcuggacggcagccccuuccuggccuucgaggcccccgcccccaccggcuuccccgaccugggcaccagcgacuggcacguggagaugagccugaacagcaacagccagagcagcggcaaccccauccugcugagagacauccagcccaacagcagcgacuucgugccccaccugggcagcguggccgugaccaccgccaucgacguggccggcgacuacaccggcaccauccaguggaccagccagcccagcaacgugacccccgugcccgacgugaacuucuggaccaucccccaguacggcagcaaccuggccgaggccagccagcuggcccccgugguguacccccccggcuucggcgaggccaucguguacuucaugagccccauccccggccccaacaccgcccacaagcccaaccuggugcccugccugcugccccaggaguucgugacccacuucgugagcgagcaggcccccagcaugggcgaggccgcccuggugcacuacguggaccccgacaccaacagaaaccugggcgaguucaagcuguaccccgagggcuucaucaccugcgugcccaacggcaccggcccccagcagcugccccugaacggcguguucguguucgccagcugggugagcagauucuaccagcugaagcccgugggcaccgccagcagcgccagaggcagacugggcgugagaagauga

SEQ ID NO: 24010 - RNA, 1671 nt, Artificial Sequence
  derived and/or modified sequence opt4 from capsid_protein__Norovirus__CAR95870
augaagauggccagcagcgacgccgcccccagcaccgacggcgccggcaaccuggugcccgagagccagcaggaggugcugccccuggcccccguggccggcgccgcccuggccgcccccguggugggccagaccaacaucaucgaccccuggaucaaggagaacuucgugcaggccccccagggcgaguucaccgugagccccaagaacagccccggcgagauccuggugaaccuggagcugggccccaagcugaaccccuaccuggaccaccugagcagaauguacaacagcuacgccggcggcaucgacgugaugguggugcuggccggcaacgccuucaccgccggcaaggugcugaucgccgccaucccccccaacuuccccguggagggcgugagcgccagccaggccacccaguucccccacgugaucaucgacgugagaacccuggaccccgugagacugccccugcccgacgugagaagcaccuucuuccacuacaccaacgacaccgagcccaagaugagacuggugaucuggcuguacaccccccugagaaccaacggcagcggcgacgacagcuucaccgugagcggcagaauccugaccagacccagccaggacuucgaguucgccuuccugaucccccccaccguggagaccaagaccacccccuucagcgugcccggcuucagcgugcaggagaugagcaacagcagauggcccgccgccaucagcgccaugguggugagaggcaacgagccccagguggugcaguuccagaacggcagagcccaccuggacggcaugcugcugggcaccacccccgugagccccaacuacaucgccagcuacagaggcaucagcaccggcaacagcagaagcgccagcagcgaggccgacgagagagccgugggcagcuucgacgugugggugagacugcaggagcccgacggccagcccuacgacaucuucggcaagcagcccgcccccaucggcacccccgacuucaaggccgugaucgugggcuucgccgccagaccccugaccagcggcagcuacgccaacgaggccuacgugaacaccaccgccagcgacuacgcccccgccaccggcaacaugagauucaccgugagaaacggcggcaccggccacaucagcgccaacaaguacugggaguucaagagcuucggcguggagggcgagagacacaccaacauccaguaccaggaguacgagcugcccgacuacagcggccagguggccagcaaccacaaccuggccccccccguggcccccagaaugcccggcgagagccugcugcuguuccagagcaacaugcccgugugggacgacggccacggcgagagcacccccaagaagauccacugccugcugccccaggaguucaucggccacuucuucgacaagcaggcccccagccugggcgacgccgcccugcugagauacgugaaccaggagaccaacagagugcuguucgagugcaagcuguacagagacggcuacaucaccguggccgccagcagcggccugcuggacuucccccuggacggcuucuucagauucgacagcugggugagcagcuucuacauccugagccccgugggcagcggccagggcagaagaggcagagugagauuccaguga

SEQ ID NO: 24011 - RNA, 1623 nt, Artificial Sequence; identical to SEQ ID NO: 23157
  derived and/or modified sequence opt4 from capsid_protein_VP1__Norovirus__ADB27914

SEQ ID NO: 24012 - RNA, 1623 nt, Artificial Sequence; identical to SEQ ID NO: 22055
  derived and/or modified sequence opt4 from capsid_protein_VP1__Norovirus__ADI45809

SEQ ID NO: 24013 - RNA, 1623 nt, Artificial Sequence; identical to SEQ ID NO: 22612
  derived and/or modified sequence opt4 from capsid_protein_VP1__Norovirus__ADI45810

SEQ ID NO: 24014 - RNA, 1623 nt, Artificial Sequence; identical to SEQ ID NO: 22056
  derived and/or modified sequence opt4 from capsid_protein_VP1__Norovirus__ADI45813

SEQ ID NO: 24015 - RNA, 1608 nt, Artificial Sequence; identical to SEQ ID NO: 22278
  derived and/or modified sequence opt4 from capsid_protein_VP1__Norovirus__ADT70684

SEQ ID NO: 24016 - RNA, 1608 nt, Artificial Sequence; identical to SEQ ID NO: 22557
  derived and/or modified sequence opt4 from capsid_protein_VP1__Norovirus__ADZ24003

SEQ ID NO: 24017 - RNA, 1623 nt, Artificial Sequence; identical to SEQ ID NO: 22276
  derived and/or modified sequence opt4 from capsid_protein_VP1__Norovirus__AFI08234

SEQ ID NO: 24018 - RNA, 1623 nt, Artificial Sequence; identical to SEQ ID NO: 22065
  derived and/or modified sequence opt4 from capsid_protein_VP1__Norovirus__AFI08237

SEQ ID NO: 24019 - RNA, 1623 nt, Artificial Sequence; identical to SEQ ID NO: 22100
  derived and/or modified sequence opt4 from capsid_protein_VP1__Norovirus__AFI08243

SEQ ID NO: 24020 - RNA, 1593 nt, Artificial Sequence; identical to SEQ ID NO: 22213
  derived and/or modified sequence opt4 from capsid_protein_VP1__Norovirus__AFJ38516

SEQ ID NO: 24021 - RNA, 1620 nt, Artificial Sequence; identical to SEQ ID NO: 22506
  derived and/or modified sequence opt4 from capsid_protein_VP1__Norovirus__AFJ38519

SEQ ID NO: 24022 - RNA, 1623 nt, Artificial Sequence; identical to SEQ ID NO: 22070
  derived and/or modified sequence opt4 from capsid_protein_VP1__Norovirus__AFW15937

SEQ ID NO: 24023 - RNA, 1623 nt, Artificial Sequence; identical to SEQ ID NO: 22069
  derived and/or modified sequence opt4 from capsid_protein_VP1__Norovirus__AFW15939

SEQ ID NO: 24024 - RNA, 1623 nt, Artificial Sequence; identical to SEQ ID NO: 22671
  derived and/or modified sequence opt4 from capsid_protein_VP1__Norovirus__AFW15942

SEQ ID NO: 24025 - RNA, 1623 nt, Artificial Sequence; identical to SEQ ID NO: 22071
  derived and/or modified sequence opt4 from capsid_protein_VP1__Norovirus__AFW15943

SEQ ID NO: 24026 - RNA, 1623 nt, Artificial Sequence; identical to SEQ ID NO: 22072
  derived and/or modified sequence opt4 from capsid_protein_VP1__Norovirus__AFW15946

SEQ ID NO: 24027 - RNA, 1647 nt, Artificial Sequence; identical to SEQ ID NO: 22655
  derived and/or modified sequence opt4 from capsid_protein_VP1__Norovirus__AFX71656

SEQ ID NO: 24028 - RNA, 1629 nt, Artificial Sequence; identical to SEQ ID NO: 22653
  derived and/or modified sequence opt4 from capsid_protein_VP1__Norovirus__AFX71659

SEQ ID NO: 24029 - RNA, 1623 nt, Artificial Sequence; identical to SEQ ID NO: 22098
  derived and/or modified sequence opt4 from capsid_protein_VP1__Norovirus__AFX81124

SEQ ID NO: 24030 - RNA, 1623 nt, Artificial Sequence; identical to SEQ ID NO: 22119
  derived and/or modified sequence opt4 from capsid_protein_VP1__Norovirus__AFX81133

SEQ ID NO: 24031 - RNA, 1623 nt, Artificial Sequence; identical to SEQ ID NO: 22267
  derived and/or modified sequence opt4 from capsid_protein_VP1__Norovirus__AFX81151

SEQ ID NO: 24032 - RNA, 1623 nt, Artificial Sequence; identical to SEQ ID NO: 22318
  derived and/or modified sequence opt4 from capsid_protein_VP1__Norovirus__AFX81160

SEQ ID NO: 24033 - RNA, 1623 nt, Artificial Sequence; identical to SEQ ID NO: 22200
  derived and/or modified sequence opt4 from capsid_protein_VP1__Norovirus__AFX81175

SEQ ID NO: 24034 - RNA, 1623 nt, Artificial Sequence; identical to SEQ ID NO: 22115
  derived and/or modified sequence opt4 from capsid_protein_VP1__Norovirus__AFX81184

SEQ ID NO: 24035 - RNA, 1623 nt, Artificial Sequence; identical to SEQ ID NO: 22152
  derived and/or modified sequence opt4 from capsid_protein_VP1__Norovirus__AFX81187

SEQ ID NO: 24036 - RNA, 1623 nt, Artificial Sequence; identical to SEQ ID NO: 22359
  derived and/or modified sequence opt4 from capsid_protein_VP1__Norovirus__AFX81217

SEQ ID NO: 24037 - RNA, 1623 nt, Artificial Sequence; identical to SEQ ID NO: 22349
  derived and/or modified sequence opt4 from capsid_protein_VP1__Norovirus__AFX81220

SEQ ID NO: 24038 - RNA, 1623 nt, Artificial Sequence; identical to SEQ ID NO: 22171
  derived and/or modified sequence opt4 from capsid_protein_VP1__Norovirus__AFX81223

SEQ ID NO: 24039 - RNA, 1623 nt, Artificial Sequence; identical to SEQ ID NO: 22108
  derived and/or modified sequence opt4 from capsid_protein_VP1__Norovirus__AFX81235

SEQ ID NO: 24040 - RNA, 1623 nt, Artificial Sequence; identical to SEQ ID NO: 22150
  derived and/or modified sequence opt4 from capsid_protein_VP1__Norovirus__AFX81259

SEQ ID NO: 24041 - RNA, 1623 nt, Artificial Sequence; identical to SEQ ID NO: 22139
  derived and/or modified sequence opt4 from capsid_protein_VP1__Norovirus__AFX81280

SEQ ID NO: 24042 - RNA, 1623 nt, Artificial Sequence; identical to SEQ ID NO: 22291
  derived and/or modified sequence opt4 from capsid_protein_VP1__Norovirus__AFX81286

SEQ ID NO: 24043 - RNA, 1623 nt, Artificial Sequence; identical to SEQ ID NO: 22147
  derived and/or modified sequence opt4 from capsid_protein_VP1__Norovirus__AFX81310

SEQ ID NO: 24044 - RNA, 1623 nt, Artificial Sequence; identical to SEQ ID NO: 22368
  derived and/or modified sequence opt4 from capsid_protein_VP1__Norovirus__AGE89469

SEQ ID NO: 24045 - RNA, 1623 nt, Artificial Sequence; identical to SEQ ID NO: 22332
  derived and/or modified sequence opt4 from capsid_protein_VP1__Norovirus__AGE89484

SEQ ID NO: 24046 - RNA, 1623 nt, Artificial Sequence; identical to SEQ ID NO: 22169
  derived and/or modified sequence opt4 from capsid_protein_VP1__Norovirus__AGE89487

SEQ ID NO: 24047 - RNA, 1623 nt, Artificial Sequence; identical to SEQ ID NO: 22205
  derived and/or modified sequence opt4 from capsid_protein_VP1__Norovirus__AGE89619

SEQ ID NO: 24048 - RNA, 1623 nt, Artificial Sequence; identical to SEQ ID NO: 22314
  derived and/or modified sequence opt4 from capsid_protein_VP1__Norovirus__AGE89670

SEQ ID NO: 24049 - RNA, 1623 nt, Artificial Sequence; identical to SEQ ID NO: 22208
  derived and/or modified sequence opt4 from capsid_protein_VP1__Norovirus__AGE99596

SEQ ID NO: 24050 - RNA, 1653 nt, Artificial Sequence; identical to SEQ ID NO: 22651
  derived and/or modified sequence opt4 from capsid_protein_VP1__Norovirus__AGE99599

SEQ ID NO: 24051 - RNA, 1620 nt, Artificial Sequence; identical to SEQ ID NO: 22455
  derived and/or modified sequence opt4 from capsid_protein_VP1__Norovirus__AGE99612

SEQ ID NO: 24052 - RNA, 1647 nt, Artificial Sequence; identical to SEQ ID NO: 22656
  derived and/or modified sequence opt4 from capsid_protein_VP1__Norovirus__AGI17609

SEQ ID NO: 24053 - RNA, 1593 nt, Artificial Sequence; identical to SEQ ID NO: 22214
  derived and/or modified sequence opt4 from capsid_protein_VP1__Norovirus__AGM33211

SEQ ID NO: 24054 - RNA, 1593 nt, Artificial Sequence; identical to SEQ ID NO: 22219
  derived and/or modified sequence opt4 from capsid_protein_VP1__Norovirus__AGM33223

SEQ ID NO: 24055 - RNA, 1623 nt, Artificial Sequence; identical to SEQ ID NO: 22249
  derived and/or modified sequence opt4 from capsid_protein_VP1__Norovirus__AGT17839

SEQ ID NO: 24056 - RNA, 1617 nt, Artificial Sequence; identical to SEQ ID NO: 22248
  derived and/or modified sequence opt4 from capsid_protein_VP1__Norovirus__AGX85910

SEQ ID NO: 24057 - RNA, 1623 nt, Artificial Sequence; identical to SEQ ID NO: 22719
  derived and/or modified sequence opt4 from capsid_protein_VP1__Norovirus__AHI59162

SEQ ID NO: 24058 - RNA, 1620 nt, Artificial Sequence; identical to SEQ ID NO: 22676
  derived and/or modified sequence opt4 from capsid_protein_VP1__Norovirus__AHI59165

SEQ ID NO: 24059 - RNA, 1623 nt, Artificial Sequence; identical to SEQ ID NO: 22265
  derived and/or modified sequence opt4 from capsid_protein_VP1__Norovirus__AHX22044

SEQ ID NO: 24060 - RNA, 1623 nt, Artificial Sequence; identical to SEQ ID NO: 22298
  derived and/or modified sequence opt4 from capsid_protein_VP1__Norovirus__AII02587

SEQ ID NO: 24061 - RNA, 1647 nt, Artificial Sequence; identical to SEQ ID NO: 22283
  derived and/or modified sequence opt4 from capsid_protein_VP1__Norovirus__AII02617

SEQ ID NO: 24062 - RNA, 1647 nt, Artificial Sequence; identical to SEQ ID NO: 22371
  derived and/or modified sequence opt4 from capsid_protein_VP1__Norovirus__AIS24556

SEQ ID NO: 24063 - RNA, 1623 nt, Artificial Sequence; identical to SEQ ID NO: 22548
  derived and/or modified sequence opt4 from capsid_protein_VP1__Norovirus__BAI49908

SEQ ID NO: 24064 - RNA, 1623 nt, Artificial Sequence; identical to SEQ ID NO: 22385
  derived and/or modified sequence opt4 from capsid_protein_VP1__Norovirus__BAI49913

SEQ ID NO: 24065 - RNA, 1623 nt, Artificial Sequence; identical to SEQ ID NO: 22392
  derived and/or modified sequence opt4 from capsid_protein_VP1__Norovirus__BAI49922

SEQ ID NO: 24066 - RNA, 1608 nt, Artificial Sequence; identical to SEQ ID NO: 22400
  derived and/or modified sequence opt4 from capsid_protein_VP1__Norovirus__BAJ25074

SEQ ID NO: 24067 - RNA, 1617 nt, Artificial Sequence; identical to SEQ ID NO: 22410
  derived and/or modified sequence opt4 from capsid_protein_VP1__Norovirus__BAP33934

SEQ ID NO: 24068 - RNA, 1623 nt, Artificial Sequence
  derived and/or modified sequence opt4 from major_capsid_protein__Norovirus__ABQ63283
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucguguucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcaccaucguggugcagccccagaacggcagaugcaccaccgacggcgugcugcugggcaccacccagcugagccccgugaacaucugcaccuucagaggcgacgugacccacaucgccggcacccaggaguacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcgugaacuucacccccaagcugggcagaauccaguucagcaccgacaccagcaacgacuucgagaccggccagagcaccagauucacccccgugggcguggugcaggacggcagcaccacccaccagaacgagccccagcagugggugcugcccgacuacagcggcagagacagccacaacgugcaccuggcccccgccguggcccccagcuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24069 - RNA, 1623 nt, Artificial Sequence
  derived and/or modified sequence opt4 from major_capsid_protein__Norovirus__ABV55634
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaaguggaacaaguacgaccccaccgaggagauccccgccccccugggcacccccgacuucgugggcaagauccagggcgugcugacccagaccaccaagggcgacggcagcaccagaggccacaaggccaccaucuacaccggcagcgcccccuucacccccaagcugggcagcgugcaguucagcaccgacaccgagaacgacuucgagacccaccagaacaccaaguucacccccgugggcgugacccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24070 - RNA, 1623 nt, Artificial Sequence
  derived and/or modified sequence opt4 from major_capsid_protein__Norovirus__ACV41093
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagagacuguacaccggccccagcagcgccuucguggugcagccccagaacggcagaugcaccaccgacggcgugcugcugggcaccacccagcugagcgccgugaacaucugcaccuucagaggcgacgugacccacaucgccggcagcagaaacuacaccaugaaccuggccagccagaacuggagcaacuacgaccccaccgaggagauccccgccccccugggcacccccgacuucgugggcaagauccagggcaugcugacccagaccaccggcagagacggcagcaccagaggccacaaggccaccgugcugaccggcagcgccgacuucgcccccaagcugggcagagugcaguucgccaccgacaccgacaacgacuucgagagcggcgagaacaccaaguucacccccgugggcgugauccaggacggcagcaccacccacagaaacgagccccagcagugggugcugcccaacuacagcggcagaaccggccacaacgugcaccuggcccccgccguggcccccaccuaccccggcgagcagcugcuguucuucagaagcaccaugcccggcugcagcggcuaccccaacauggaccuggacugccugcugccccaggagugggugagacacuucuaccaggaggccgcccccgcccagagcgacguggcccugcugagauucgugaaccccgacaccggcagagugcuguucgagugcaagcugcacaagcccggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24071 - RNA, 1635 nt, Artificial Sequence
  derived and/or modified sequence opt4 from major_capsid_protein__Norovirus__ACV41096
augaugauggccagcaaggacgccacccccagcgccgacggcgccaccggcgccggccagcuggugcccgaggugaacaccgccgaccccauccccaucgaccccguggccggcagcagcaccgcccuggccaccgccggccaggugaaccugaucgaccccuggaucaucaacaacuucgugcaggccccccagggcgaguucaccaucagccccaacaacacccccggcgacgugcuguucgaccugcagcugggcccccaccugaaccccuuccugagccaccugagccagauguacaacggcugggugggcaacaugagagugagaguggugcuggccggcaacgccuucaccgccggcaaggugaucaucugcugcgugccccccggcuuccagagcagaacccugagcaucgcccaggccacccuguucccccacgugaucgccgacgugagaacccuggaccccguggaggugccccuggaggacgugagaaacgugcuguaccacaacaacgacacccagcccaccaugagacugcugugcaugcuguacaccccccugagaaccggcggcgccagcggcggcaccgacagcuucgugguggccggcagagugcugaccugccccggccccgacuucaacuuccuguuccuggugccccccaccguggagcagaagaccagacccuucaccgugcccaacaucccccugaaguaccugagcaacagcagaauccccaaccccaucgagggcaugagccugagccccgaccagacccagaacgugcaguuccagaacggcagaugcaccaucgacggccagccccugggcaccacccccgugagcgugagccagcugugcaaguucagaggcagaaucaccagcggccagagagugcugaaccugaccgagcuggacggcagccccuucauggccuucgccgcccccgcccccgccggcuuccccgaccugggcagcugcgacuggcacaucgagaugagcaagauccccaacagcagcacccagaacaaccccaucguggugaacagcgugaagcccaacagccagcaguucgugccccaccugagcagcaucacccuggacgacaacgugagcagcggcggcgacuacaucggcaccauccaguggaccagcccccccagcgacagcggcggcgccaacaccaacuucuggaagauccccgacuacggcagcagccuggccgaggccagccagcuggcccccgccguguacccccccggcuucaacgaggugaucguguacuucauggccagcauccccggccccaaccagagcggcagccccaaccuggugcccugccugcugccccaggaguacaucacccacuucaucagcgagcaggcccccauccagggcgaggccgcccugcugcacuacguggaccccgacaccaacagaaaccugggcgaguucaagcuguaccccggcggcuaccugaccugcgugcccaacagcagcagcaccggcccccagcagcugccccuggacggcguguucguguucgccagcugggugagcagauucuaccagcugaagcccgugggcaccgccggccccgccagaggcagacugggcgugagaagauga

SEQ ID NO: 24072 - RNA, 1743 nt, Artificial Sequence
  derived and/or modified sequence opt4 from major_capsid_protein__Norovirus__ACV88130
augaagauggccagcaacgacgccaccgcccccagccaggacggcgccgccaaccuggugcccgagagccagcacgaggugcuggcccuggagcccguggccggcgccgcccuggccgcccccguggccggccaguucaacgccaucgaccccuggaucaagcagaacuucgugcaggcccccgccggcgaguucaccgugagccccagaaacgcccccggcgagauccugauggaccuggagcugggccccgagcugagccccuuccuggcccaccuggcccagauguacaacgccuacgccggcggcauggaggugcagaucauccuggccggcaacgccuucaccgccggcaagaucaucgugugcgccgugccccccaacuucccccccgacagacugagcgccagccaggccaccaacuucccccacgugaucauggacgugagaacccuggagcccgugauccugccccugcccgacgugagagccggcuucuuccacuacaaccagcugagagagcccagaaugagacugauggcccugcuguacaccccccugagagccaacggcaccggcgacgacgccuucaccgugagcugcagagugcugaccagacccaugcaggacuucgaguucauguuccuggugccccccaccguggagagcagagugacccccuucagcgugcccaccuaccccgugguggagaugaccaacagcagauggcccgccagaaucagcggcaugcacgugaacgccaaccagacccuggccgugcaguuccagaacggcagaugcacccuggacggccagcugaugggcaccacccagcugugcgccgccgacgugugcagaaugagaggcagauacaccagcaccagagccgaccuggccggcguggaccacaccgaccagggccccagccugggcgccggccccagcaacgaccccgugagcgugcccgaggccagaagccagaccagaaccagcgugagcgcccaccugcagcuggaggagcugaacggccagcccuacgagguguacggcgagcagcccgccccccugggcacccccgacuucugcugcagacugaugggcgagcuggugagacugcccagcaccagccccgccgcccagagcagauucagagacgccuucuucgacaccuacggcgcccuguucgcccccgccgugggcagcaccaccuucaccgugaacaacagcagcaccagcgacuucgccaacggccagcccuucgaguuccugcccaucggcguggagaucggcaacagcgcccaguacgacgaguucgcccugcccagcuacaacggcgccaucggcgagaacagacaccuggcccccguggccgcccccggcuuccccggcgagaacaucguguucuucagcagcaaccugcccgugugggacagcaccagcgcccagaacaacagaagaaucagcugccugcugcccaacgaguucgugcagcacuucuacgaccugcaggcccccagccagagcgacguggcccugcugagauacgugcaccccgagagcggcagagugcuguucgagugcaagcuguacagagacggcuuccugaccgugaacggcgccagccuggccgaguuccccgugaacggcuacuucagauucgacagcugggugaaccaguucuucacccugagccccgugggcaccggcagcggcagaagcggcagaagcagaaacgcccaguga

SEQ ID NO: 24073 - RNA, 1623 nt, Artificial Sequence; identical to SEQ ID NO: 23219
  derived and/or modified sequence opt4 from major_capsid_protein__Norovirus__ACW19927

SEQ ID NO: 24074 - RNA, 1623 nt, Artificial Sequence
  derived and/or modified sequence opt4 from major_capsid_protein__Norovirus__ACX31885
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagagacuguacaccggccccagcagcgccuucguggugcagccccagaacggcagaugcaccaccgacggcgugcugcugggcaccacccagcugagcgccgugaacaucugcaccuucagaggcgacgugacccacaucgccggcagcagaaacuacaccaugaaccuggccagccagaacuggaacaacuacgaccccaccgaggagauccccgccccccugggcacccccgacuucgugggcaagauccagggcaugcugacccagaccaccagaagcgacggcagcaccagaggccacaaggccaccgugcugaccggcagcgccgacuucgcccccaagcugggcagagugcaguucgccaccgacaccgacaacgacuucgagagcggccagaacaccaaguucacccccgugggcgugauccaggacggcagcaccacccacagaaacgagccccagcagugggugcugcccaacuacagcggcagaaccggccacaacgugcaccuggcccccgccguggcccccaccuaccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24075 - RNA, 1623 nt, Artificial Sequence
  derived and/or modified sequence opt4 from major_capsid_protein__Norovirus__ACX31887
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccaacuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugauccccagcaacggcuacuucagauucgacagcugggugaaccaguucuacacccuggcccccaugggcaacggcaccggcagaagaagagcccuguga

SEQ ID NO: 24076 - RNA, 1623 nt, Artificial Sequence
  derived and/or modified sequence opt4 from major_capsid_protein__Norovirus__ACX31891
augaagauggccagcagcgacgccagccccagcgacggcagcgccgccaaccuggugcccgaggugaacaacgaggugauggcccuggagcccguggugggcgccgccaucgccgcccccguggccggccagcagaacaucaucgaccccuggaucagaaacaacuucgugcaggcccccggcggcgaguucaccgugagccccagaaacgcccccggcgagauccuguggagcgccccccugggccccgaccugaaccccuaccugagccaccugagcagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagaccaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagagacuguacaccggccccagcagcgccuucguggugcagccccagaacggcagaugcaccaccgacggcgugcugcugggcaccacccagcugagcgccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcaugcugacccagaccaccagaggcgacggcagcaccagaggccacaaggccaccguguacaccggcagcgccgacuucgcccccaagcugggcagagugcaguucgccaccgacaccgacaacgacuucgagagcaaccagaacaccaaguucacccccgugggcgugauccaggacggcaacaccacccaccagaacgagccccagcagugggugcugcccggcuacagcggcagagacggccacaacgugcaccuggcccccgccguggcccccaccuaccccggcgagcagcugcuguucuucagaagcaccaugcccggcugcagcggcuaccccaacaugaaccuggacugccugcugccccaggagugggugcagcacuucuaccaggaggccgcccccgcccagagcgagguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagagcccuguga

SEQ ID NO: 24077 - RNA, 1623 nt, Artificial Sequence
  derived and/or modified sequence opt4 from major_capsid_protein__Norovirus__ACZ37232
augaagauggccagcaacgacgccgcccccagcaacgacggcgccgccggccuggugcccgagaucaacaacgaggugaugccccuggagcccguggccggcgccagccuggccacccccguggugggccagcagaacaucaucgaccccuggaucagaaacaacuucgugcaggcccccgccggcgaguucaccgugagccccagaaacagccccggcgagauccugcuggaccuggagcugggccccgagcugaaccccuaccuggcccaccuggccagaauguacaacggccacgccggcggcauggaggugcagaucgugcuggccggcaacgccuucaccgccggcaagaucaucuucgccgccaucccccccggcuuccccuacgagaaccugagccccagccagaucaccaugugcccccacgugaucaucgacgugagacagcuggagcccgugcugcugcccaugcccgacaucagaaacaacuucuuccacuacaaccagggcaacgaccccaagcugagacugguggccaugcuguacaccccccugagagccaacaacagcggcgacgacguguucaccgugagcugcagagugcugaccaagcccagccccgacuucgaguucaccuuccuggugccccccaccguggagagcaagaccaagcaguucacccugcccauccugaagaucagcgagaugaccaacagcagauuccccgugcccguggagaugauguacaccgccagaaacgagaaccagguggugcagccccagaacggcagagugacccuggacggcgagcugcugggcaccaccccccugcuggccgugaacaucugcaaguucaagggcgaggugaucgccaagaacggcgacgugagaagcuacagaauggacauggagaucaccaacaccgacggcacccccaucgaccccaccgaggacacccccggccccaucggcagccccgacuuccagggcauccuguucggcguggccagccagagaaacaccaacgagcccaaccccgccaccagagcccacgaggccaacaucaacaccggcggcgaccaguacgcccccaagcuggcccaggugaaguucuucagcgagagccaggacuucgaggugcaccagcccaccguguucacccccgugggcguggccggcgacaccagccaccccuucagacagugggugcugcccagauacggcggccaccugaccaacaacacccaccuggcccccgccguggccccccuguuccccggcgagcagauccuguucuucagaagccagauccccagcagcggcggccacgagcugggcuacauggacugccuggugccccaggagugggugcagcacuucuaccaggaggccgccaccgcccagagcgagguggcccugaucagauucaucaaccccgacaccggcagagugcuguucgaggccaagcugcacaagcagggcuucaucaccguggcccacaccggcgacaaccccaucgugaugccccccaacggcuacuucagauucgaggccugggugaaccaguucuacagccuggcccccgugggcaccggcaacggcagaagaagaauccaguga

SEQ ID NO: 24078 - RNA, 1623 nt, Artificial Sequence; identical to SEQ ID NO: 22072
  derived and/or modified sequence opt4 from major_capsid_protein__Norovirus__ADD10375

SEQ ID NO: 24079 - RNA, 1623 nt, Artificial Sequence
  derived and/or modified sequence opt4 from major_capsid_protein__Norovirus__ADO85552
augaagauggccagcagcgacgccaaccccagcgacggcagcaccgccaaccuggugcccgaggugaacaacgaggugauggcccuggagcccguggugggcgccgccagcgccgcccccguggccggccagcagaacgugaucgaccccuggaucagaaacaacuucgugcaggcccccggcggcgaguucaccgagagccccaccaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugcccgccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgcccccgugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24080 - RNA, 1623 nt, Artificial Sequence
  derived and/or modified sequence opt4 from major_capsid_protein__Norovirus__ADQ43779
augaagauggccagcaacgacgccagccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggcccugcccagcuacagcggcagaaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24081 - RNA, 1623 nt, Artificial Sequence; identical to SEQ ID NO: 22112
  derived and/or modified sequence opt4 from major_capsid_protein__Norovirus__ADQ43781

SEQ ID NO: 24082 - RNA, 1623 nt, Artificial Sequence; identical to SEQ ID NO: 22612
  derived and/or modified sequence opt4 from major_capsid_protein__Norovirus__ADQ43783

SEQ ID NO: 24083 - RNA, 1623 nt, Artificial Sequence; identical to SEQ ID NO: 22612
  derived and/or modified sequence opt4 from major_capsid_protein__Norovirus__ADV37805

SEQ ID NO: 24084 - RNA, 1623 nt, Artificial Sequence; identical to SEQ ID NO: 22612
  derived and/or modified sequence opt4 from major_capsid_protein__Norovirus__ADV37807

SEQ ID NO: 24085 - RNA, 1623 nt, Artificial Sequence; identical to SEQ ID NO: 22612
  derived and/or modified sequence opt4 from major_capsid_protein__Norovirus__ADV37809

SEQ ID NO: 24086 - RNA, 1623 nt, Artificial Sequence
  derived and/or modified sequence opt4 from major_capsid_protein__Norovirus__ADV37813
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgaccuggagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24087 - RNA, 1623 nt, Artificial Sequence
  derived and/or modified sequence opt4 from major_capsid_protein__Norovirus__ADV37917
augaagauggccagcagcgacaccaagaccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaucgacggcgugcugcugggcaccacccagcugagccccgugaacaucugcaccuucagaggcgacgugacccacaucaccggcagcagaaacuacaccaugaaccuggccacccagaacuggaacagcuacgaccccaccgaggagauccccgccccccugggcacccccgacuucgugggcaagauccagggcgugcugacccagaccaccagagccgacggcagcaccagaggccacaaggccaccguguacaccggcagcgccgacuucgcccccaagcugggcagagugcaguucgccaccgacaccgacaacgacuucgacgccaaccagaacaccaaguucacccccgugggcgugauccaggacggcaacaccgcccacagaaacgagccccagcagugggugcugcccagcuacagcggcagaaacagccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24088 - RNA, 1623 nt, Artificial Sequence
  derived and/or modified sequence opt4 from major_capsid_protein__Norovirus__ADV37919
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaucgacggcgugcugcugggcaccacccagcugagccccgugaacaucugcaccuucagaggcgacgugacccacaucaccggcagcagaaacuacaccaugaaccuggccacccagaacuggaacagcuacgaccccaccgaggagauccccgccccccugggcacccccgacuucgugggcaagauccagggcgugcugacccagaccaccagagccgacggcagcaccagaggccacaaggccaccguguacaccggcagcgccgacuucgcccccaagcugggcagagugcaguucgccaccgacaccgacaacgacuucgacgccaaccagaacaccaaguucacccccgugggcgugauccaggacggcaacaccgcccacagaaacgagccccagcagugggugcugcccagcuacagcggcagaaacagccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24089 - RNA, 1608 nt, Artificial Sequence
  derived and/or modified sequence opt4 from major_capsid_protein__Norovirus__AEI83469
augaagauggccagcaacgacgccgcccccagcaacgacggcgccgccggccuggugcccgaggugaacaacgagaccauggcccuggagcccguggccggcgccagcaucgccgccccccugaccggccagaacaacgugaucgaccccuggaucagacugaacuucgugcaggcccccaacggcgaguucaccgugagccccagaaacagccccggcgaggugcugcugaaccuggagcugggccccgagcugaaccccuaccuggcccaccugagcagaauguacaacggcuacgccggcggcguggaggugcaggugcugcuggccggcaacgccuucaccgccggcaagcugguguucgccgccgugcccccccacuucccccuggagaacaucagccccggccagaucaccauguucccccacgugaucaucgacgugagaacccuggagcccgugcugcugccccugcccgacgugagaaacaacuucuuccacuacaaccagcagaacgagcccagaaugagacugguggccaugcuguacaccccccugagaagcaacggcagcggcgacgacguguucaccgugagcugcagagugcugaccagacccagccccgacuucgacuucaacuaccuggugccccccaccguggagagcaagaccaagcccuucacccugcccauccugaccaucggcgagcugaccaacagcagauuccccgugcccaucgacgagcuguacaccagccccaacgagagccugguggugcagccccagaacggcagaugcgcccuggacggcgagcugcagggcaccacccagcugcugcccaccgccaucugcagcuucagaggcagaaucaaccagaaggugagcggcgagaaccacguguggaacaugcaggugaccaacaucaacggcacccccuucgaccccaccgaggacgugcccgccccccugggcacccccgacuucagcggcaagcuguucggcgugcugagccagagagaccacgacaacgccugcagaagccacgacgccgugaucgccaccaacagcgccaaguucacccccaagcugggcgccauccagaucggcaccugggaggaggacgacgugcacaucaaccagcccaccaaguucacccccgugggccuguucgagagcgagggcuucaaccaguggacccugcccaacuacagcggcgcccugacccugaacaugggccuggccccccccguggcccccaccuuccccggcgagcagauccuguucuucagaagccacaucagccugaagggcggcguggccgaccccgugaucgacugccugcugccccaggaguggauccagcaccuguaccaggagagcgcccccagccagaccgacguggcccugaucagauucaccaaccccgacaccggcagagugcuguucgaggccaagcugcacagaagcggcuacaucaccguggccaacaccggcagcagacccaucguggugcccgccaacggcuacuucagauucgacagcugggugaaccaguucuacagccuggcccccaugggcaccggcaacggcagaagaagagugcaguga

SEQ ID NO: 24090 - RNA, 1644 nt, Artificial Sequence
  derived and/or modified sequence opt4 from major_capsid_protein__Norovirus__AEP04093
augaagauggccagcaacgacgccgcccccagcaccgacggcagcgccggccuggugcccgaggugaacaacgagaccauggcccuggagcccguggugggcgccccccuggccgcccccguggccggccagcacaacaucaucgaccccuggaucaagaugaacuucgugcaggcccccaacggcgaguucaccgugagccccagaaacgcccccggcgagauccugcuggaccuggagcugggccccgaccugaaccccuaccugagccaccuggccagaauguacaacggcuacgccggcggcauggaggugcagguggugcuggccggcaacgccuucaccgccggcaagaucaucuucgccgccgugccccccaacuuccccgccgagaaccugagcgccgcccaggugaccaugugcccccacgugaucguggacgugagacagcuggagcccgugaugcugcccaugcccgacaucagaaacaagcuguuccacuacaaccagguggacgaccccaagcugagacugcuggccuaccuguacaccccccugagagccaacaacgccggcgacgacguguucaccgugagcugcagagugcugaccagacccacccccgacuucgaguucauguuccuggugccccccaccguggagagcaagaccaagcccuucagccugcccagccugacccuggacgagcugagcaacagcagauuccccgcccccaucgugcagcuguacaccaacccccacgacaaccugguggugcagccccagaacggcagaugcaccaucgacggccugcugcagggcaccacccagcuggugagcugcaacgugugcagcuucagaggcaccaucggcgacggccagcccgccagccacagcgaggaggagaucaugcccauggccuucaacauccagagagagcugaugcuggagaaccuggacggcagccccuacgaccccaccgacgacauccccgccgugcugggcagccccgacuuccagggcgugaucuucggcauccugagccagagaaacggcgacggccagaccagagcccacgaggccaagguggacaccagagccgccagauucgcccccaagcugggcuucgugguggccaccguggagagcaccgacuuccacgccaaccagcccagcagauucacccccgugggccugggcggcgacggcaaccaggacuucgcccaguggaaccugcccaccuacggcggcgcccugaccaacaacaccaaccuggccccccccgugaugcccguguaccccggcgagcagcugcuguucuucagaagccagcugcccagcagcggcggcguggugggcggcuggcuggacugccugcugccccaggagugggugcagcacuucuuccaggagagcgccaccagccagagcgacguggcccuggugagauacaucaaccccaccaccggcagagugcuguucgaggccaagcugcacaagcagggcuuccugaccguggccgccagcggcagcuacccccugguggugcccgccgacggcuacuucagauucgagagcugggugaaccaguucuacacccuggcccccaugggcaacggcagcggcagaagaagaaccagauga

SEQ ID NO: 24091 - RNA, 1620 nt, Artificial Sequence
  derived and/or modified sequence opt4 from major_capsid_protein__Norovirus__AEQ77282
augaugauggccagcaaggacgcccccagcaacauggacggcaccagcggcgccggccagcuggugcccgaggugaacgccgccgagccccugccccuggagcccguggugggcgccgccaccgccgccgccaccgccggccaggugaaccugaucgaccccuggaucaugaacaacuucgugcaggcccccgagggcgaguucaccaucagccccaacaacacccccggcgacauccuguucgaccugcaccugggcccccaccugaaccccuuccugcagcaccugagccagauguacaacggcugggugggcaacaugagagugagagugaugcuggccggcaacgccuucaccgccggcaagaucaucaucugcugcgugccccccggcuucgccagccagaacaucagcaucggccaggccaccauguucccccacgugaucgccgacgugagagugcuggagcccaucgagaucccccuggacgacgugagaaacgugcuguuccacaccaacgagaacagacccaccaugagacugcugugcaugcuguacaccccccugagagccggcggcgccagcagcggcaccgaccccuucgugaucgccggcagagugcugaccugccccagccccgacuucaacuuccuguuccuggugccccccagcguggagcagaagaccagacagcugaccgugcccaacaucccccugaacaaccuggccaacagcagagugcccgccaugaucaacaagaugaccgugagcaccgaccagaaccagguggugcaguuccagaacggcagaugcacccuggagggccagcugcugggcaccacccccgugagcgccagccagguggccagaaucagaggcaagguguucagcaccgccagcggcaagggccugaaccugaccgagcuggacggcacccccuaccacgccuucgagagccccgccccccugggcuuccccgacaucggcgccugcgacuggcacgugagcaccuucaagguggaccagaaccugagcggcgaccccaugagcagacuggacgugaagcagaacgcccccuucgccccccaccugggcagcaucgaguucaccagcgaccaggaccccaccggcgaccagcugggcacccuggccugggugagccccagcaccagcggcgccagaguggaccccuggaagauccccagcuacggcagcaccgugaccgagagcacccaccuggccccccccaucuucccccccggcuucggcgaggccaucguguacuucaugagcgacuuccccaucgugagcggcaacaccgcccaggugcccugcacccugccccaggaguucgugagccacuucguggagcagcaggcccccgugagaggcgaggccgcccugcugcacuacguggaccccgacacccacagaaaccugggcgaguucaagcuguaccccgacggcuucaucaccugcgugcccaacaccggcggcggcccccagaaccugcccaccaacggcguguucguguucagcagcugggugagcagauacuaccagcugaagcccgugggcaccgccggccccgccagaagacugggcgugagaagaguguga

SEQ ID NO: 24092 - RNA, 1608 nt, Artificial Sequence
  derived and/or modified sequence opt4 from major_capsid_protein__Norovirus__AFA55174
augaagauggccagcaacgacgccgcccccagcaacgacggcgccgccggccuggugcccgaggugaacaacgagaccauggcccuggagcccguggccggcgccagcaucgccgccccccugaccggccagaacaacgugaucgaccccuggaucagaaugaacuucgugcaggcccccaacggcgaguucaccgugagccccagaaacagccccggcgaggugcugcugaaccuggagcugggccccgagcugaaccccuuccuggcccaccugagcagaauguacaacggcuacgccggcggcguggaggugcaggugcugcuggccggcaacgccuucaccgccggcaagcugguguucgccgccauccccccccacuucccccuggagaaccugagccccggccagaucaccauguucccccacgugaucaucgacgugagaacccuggagcccgugcugcugccccugcccgacgugagaaacaacuucuuccacuacaaccagcagcccgagcccagaaugagacugguggccaugcuguacaccccccugagaagcaacggcagcggcgacgacguguucaccgugagcugcagagugcugaccagacccagccccgacuucgacuucaacuaccuggugccccccaccguggagagcaagaccaagcccuucacccugcccauccugaccaucggcgagcugagcaacagcagauuccccgugcccaucgacgagcuguacaccagccccaacgagggcgugguggugcagccccagaacggcagaagcacccuggacggcgagcugcugggcaccacccagcuggugcccagcaacaucugcgcccugagaggcagaaucaacgcccaggugcccgacgaccaccaccaguggaaccugcaggugaccaacgccaacggcaccagcuucgaccccaccgaggacgugcccgccccccugggcacccccgacuuccuggccaacaucuacggcgugaccagccagagaaaccccgacaacaccugcagagcccacgacggcgugcuggccaccuggagccccaaguucacccccaagcugggcagcguggugcugggcaccugggaggagagcgaccuggaccugaaccagcccaccagauucacccccgugggccuguacgacaccggccacuucgaccagugggugcugcccaacuacagcggcagacugacccugaacaugaaccuggcccccagcguggccccccuguuccccggcgagcagauccuguucuucagaagccacaucccccugaagggcggcaccagcaacggcgccaucgacugccugcugccccaggaguggauccagcacuucuaccaggagagcgcccccagccccaccgacguggcccugaucagauacaccaaccccgacaccggcagagugcuguucgaggccaagcugcacagacagggcuucaucaccguggccaacagcggcagcagacccaucguggugccccccaacggcuacuucagauucgacagcugggugaaccaguucuacagccuggcccccaugggcaccggcaacggcagaagaagagugcaguga

SEQ ID NO: 24093 - RNA, 1629 nt, Artificial Sequence
  derived and/or modified sequence opt4 from major_capsid_protein__Norovirus__AFC89656
augaagauggccagcaacgacgccgcccccagcaacgacggcgccgccagccuggugcccgaggccaucaacgagaccaugccccuggagcccguggccggcgccagcaucgccgcccccguggccggccagaccaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccaucccccccaacuuccccguggacaugaucagccccgcccagaucaccaugcugccccaccugaucguggacgugagaacccuggagcccaucaugaucccccugcccgacgugagaaacguguucuaccacuucaacaaccagccccagcccagaaugagacugguggccaugcuguacaccccccugagaagcaacggcagcggcgacgacguguucaccgugagcugcagagugcugaccagacccacccccgacuucgaguucaucuaccuggugccccccagcguggagagcaagaccaagcccuucacccugcccauccugaccaucagcgagcugaccaacagcagauuccccaucagcaucgagcagcuguacaccgcccccaacgagaacaacguggugcagugccagaacggcagaugcacccuggacggcgagcugcagggcaccacccagcugcugagcagcgccgugugcagcuacagaggcagaaccguggccaacagcggcgacaacugggaccagaacgugcugcagcugaccuaccccagcggcgccagcuacgaccccaccgacgaggugcccgccccccugggcacccaggacuucagcggcauccuguacggcgugcugacccaggacaacgugagagagaacaccggcgaggccaagaacgccaagggcguguacaucagcaccaccagcggcaaguucacccccaagaucggcagcaucggccugcacagcaucaccgaggacgugagacccaaccagcagagcagauucacccccgugggcguggcccagaacgagaacacccccuuccagcagugggugcugccccacuacgccggcgcccuggcccugaacaccaaccuggcccccgccguggcccccaccuuccccggcgagcagcugcuguucuucagaagcagagugcccugcgugcagggccugcagggccaggacgccuucaucgacugccugcugccccaggagugggugaaccacuucuaccaggaggccgcccccagccaggccgacguggcccugaucagauacgugaaccccgacaccggcagaacccuguucgaggccaagcugcacagaagcggcuucaucaccgugagccacaccggcgccuacccccugguggugccccccaacggccacuucagauucgacagcugggugaaccaguucuacagccuggcccccaugggcaccggcaacggcagaagaagagugcaguga

SEQ ID NO: 24094 - RNA, 1617 nt, Artificial Sequence
  derived and/or modified sequence opt4 from major_capsid_protein__Norovirus__AFC89659
augaugauggccagcaaggacgcccccagcaacauggacggcaccagcggcgccggccagcuggugcccgaggugaacaccgccgagccccugccccuggagcccguggugggcgccgccaccgccgccgccaccgccggccaggugaaccugaucgaccccuggaucaugaacaacuucgugcaggcccccgagggcgaguucaccaucagccccaacaacacccccggcgacauccuguucgaccugagacugggcccccaccugaaccccuuccugcugcaccugagccagauguacaacggcugggugggcaacaugagaaucagagugaugcuggccggcaacgccuucagcgccggcaagaucaucaucugcugcgugccccccggcuucgagagccagaacaucagcaucggccaggccaccauguucccccacgugaucgccgacgugagagugcuggagcccaucgagaucccccuggacgacgugagaaacgugcuguaccacaccaacgagaacagacccaccaugagacugcugugcaugcuguacaccccccugagagccggcggcgccagcagcggcaccgaccccuucgugaucgccggcagagugcugaccugccccgcccccgacuucaacuuccuguuccuggugccccccagcguggagcagaagaccagacagcugaccauccccaacaucccccugaacaaccuggccaacagcagagugcccgccaugaucaacaagauggccgugagcgccgaccagaaccagguggugcaguuccagaacggcagaugcacccuggagggccagcugcugggcaccacccccgugagcgccaaccagguggccagaaucagaggcaagguguucagcaccaacagcggcaccggccugaaccugaccgagaccgacggcacccccuaccacgccuucgagagccccgccccccugggcuuccccgacaucggcgacugcgacuggcacguguacgccuucaaggugaaccagaacaccggcgaccccauguacagacuggacaucacccagggcaacagcuucgccccccaccugggcagcaucgaguucaccagcgaccagcaccccagcggcgaccagcugggcacccugaccuggaucagcccccugaacaacgccagcagaguggaccccuggaagauccccagcuacggcagcacccugaccgagagcaccaaccuggccccccccaucuucccccccggcuucggcgaggccaucguguacuucaugagcgacuuccccaucgugagcggcaacaccacccagauccccugcacccugccccaggaguucaucagcagcuucguggagcagcaggcccccaucagaggcgaggccgcccugcugcacuacguggaccccgacacccacagaaaccugggcgaguucaagcuguaccccgacggcuucaucaccugcgugcccaacaccggcggcggcccccagaaccugcccagcaacggcguguucaucuucagcagcugggugagcagauacuaccagcugaagcccgugggcaccgccggccccgccagaagacugggcgugagaagaaucuga
